(12) United States Patent
Bui et al.

(10) Patent No.: US 12,018,261 B2
(45) Date of Patent: Jun. 25, 2024

(54) COMPOUNDS AND METHODS FOR MODULATING FACTOR XII

(71) Applicant: Ionis Pharmaceuticals, Inc., Carlsbad, CA (US)

(72) Inventors: Huynh-Hoa Bui, San Diego, CA (US); Chenguang Zhao, San Diego, CA (US); Jeffrey R. Crosby, Carlsbad, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 17/554,920

(22) Filed: Dec. 17, 2021

(65) Prior Publication Data

US 2023/0002771 A1   Jan. 5, 2023

Related U.S. Application Data

(60) Provisional application No. 63/127,616, filed on Dec. 18, 2020.

(51) Int. Cl.
*C12N 15/113* (2010.01)

(52) U.S. Cl.
CPC ...... *C12N 15/1137* (2013.01); *C12N 2310/14* (2013.01); *C12N 2310/31* (2013.01); *C12N 2310/315* (2013.01); *C12N 2310/321* (2013.01); *C12N 2310/322* (2013.01); *C12N 2310/3341* (2013.01); *C12N 2310/341* (2013.01); *C12N 2310/346* (2013.01)

(58) Field of Classification Search
CPC ............ C12N 15/1137; C12N 2310/11; C12N 2310/14; C12N 2310/31; C12N 2310/315; C12N 2310/322; C12N 2310/341; C12N 2310/346; C12N 2310/3341; A61K 31/7088

See application file for complete search history.

(56) References Cited

U.S. PATENT DOCUMENTS

| | | |
|---|---|---|
| 3,687,808 A | 8/1972 | Merigan et al. |
| 4,415,732 A | 11/1983 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohutsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,185,444 A | 12/1993 | Summerton et al. |
| 5,276,019 A | 1/1994 | Cohen et al. |
| 5,286,717 A | 2/1994 | Cohen et al. |
| 5,319,080 A | 6/1994 | Leumann |

(Continued)

FOREIGN PATENT DOCUMENTS

| | | |
|---|---|---|
| WO | WO 1999/014226 | 3/1999 |
| WO | WO 2003/004602 | 1/2003 |

(Continued)

OTHER PUBLICATIONS

Adams et al., "Thrombin and Factor XII Drive Prostate Tumor Growth in vivo" Presentation for 57th ASH Annual Meeting and Exposition (Dec. 5-8, 2015) Orlando, FL.

Adams et al., "Thrombin and Factor XII Drive Prostate Tumor Growth in vivo" Abstract for 57th ASH Annual Meeting and Exposition (Dec. 5-8, 2015) Orlando, FL.

Adcock et al., "A laboratory approach to the evaluation of hereditary hypercoagulability" Am. J. Clin. Pathol. (1997) 108(4):434-449.

Albaek et al., "Analogues of a Locked Nucleic Acid with Three-Carbon 2',4'-Linkages: Synthesis by Ring-Closing Metathesis and Influence of Nucleic Acid Duplex Stability" J. Org. Chem. (2006) 71:7731-7740.

(Continued)

*Primary Examiner* — Terra C Gibbs
(74) *Attorney, Agent, or Firm* — Knobbe, Martens, Olson & Bear, LLP

(57) ABSTRACT

Provided are compounds, methods, and pharmaceutical compositions for reducing the amount or activity of FXII RNA in a cell or subject, and in certain instances reducing the amount of FXII protein in a cell or subject. Such compounds, methods, and pharmaceutical compositions are useful to prevent, treat, or ameliorate at least one symptom of a thromboembolic condition. Such thromboembolic conditions include deep vein thrombosis, venous or arterial thrombosis, pulmonary embolism, myocardial infarction, and stroke. Such symptoms include pain, shortness of breath, heart burn, cold sweat, fatigue, lightheadedness, dizziness, swelling, cramping, and death. Such compounds, methods, and pharmaceutical compositions are useful to prevent, treat, or ameliorate at least one symptom of hereditary angioedema.

58 Claims, No Drawings

Specification includes a Sequence Listing.

(56) References Cited

U.S. PATENT DOCUMENTS

| | | |
|---|---|---|
| 5,321,131 A | 6/1994 | Agrawal et al. |
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,166,199 A | 12/2000 | Cook et al. |
| 6,268,490 B1 | 7/2001 | Imanishi et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,670,461 B1 | 12/2003 | Wengel et al. |
| 6,770,748 B2 | 8/2004 | Imanishi et al. |
| 6,794,499 B2 | 9/2004 | Wengel et al. |
| 7,015,315 B1 | 3/2006 | Cook et al. |
| 7,034,133 B2 | 4/2006 | Wengel et al. |
| 7,053,207 B2 | 5/2006 | Wengel |
| 7,101,993 B1 | 9/2006 | Cook et al. |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,875,733 B2 | 1/2011 | Bhat et al. |
| 7,939,677 B2 | 5/2011 | Bhat et al. |
| 8,022,193 B2 | 9/2011 | Swayze et al. |
| 8,030,467 B2 | 10/2011 | Seth et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,127,276 B2 | 8/2015 | Prakash et al. |
| 9,150,864 B2 | 10/2015 | Monia et al. |
| 9,187,749 B2 | 11/2015 | Bhattacharjee et al. |
| 9,290,760 B2 | 3/2016 | Rajeev et al. |
| 10,011,836 B2 | 7/2018 | Khvorova et al. |
| 2001/0053519 A1 | 12/2001 | Fodor et al. |
| 2003/0158403 A1 | 8/2003 | Manoharan et al. |
| 2003/0175906 A1 | 9/2003 | Manoharan et al. |
| 2003/0228597 A1 | 12/2003 | Cowsert et al. |
| 2004/0171570 A1 | 9/2004 | Allerson et al. |
| 2005/0130923 A1 | 6/2005 | Bhat et al. |
| 2006/0148740 A1 | 7/2006 | Platenburg |
| 2007/0031844 A1 | 2/2007 | Khvorova et al. |

(56) References Cited

U.S. PATENT DOCUMENTS

| | | |
|---|---|---|
| 2008/0039618 A1 | 2/2008 | Allerson et al. |
| 2008/0254039 A1 | 10/2008 | Nieswandt et al. |
| 2009/0012281 A1 | 1/2009 | Swayze et al. |
| 2009/0064350 A1 | 3/2009 | Dewald |
| 2010/0137414 A1 | 6/2010 | Freier et al. |
| 2010/0190837 A1 | 7/2010 | Migawa et al. |
| 2010/0197762 A1 | 8/2010 | Swayze et al. |
| 2010/0324114 A1 | 12/2010 | Dewald |
| 2011/0067124 A1 | 3/2011 | Dewald |
| 2012/0309035 A1 | 12/2012 | Lindahl et al. |
| 2013/0130378 A1 | 5/2013 | Manoharan et al. |
| 2013/0331434 A1 | 12/2013 | Monia et al. |
| 2014/0107330 A1 | 4/2014 | Freier et al. |
| 2015/0018540 A1 | 1/2015 | Prakash et al. |
| 2015/0184153 A1 | 7/2015 | Freier et al. |
| 2015/0191727 A1 | 7/2015 | Migawa et al. |
| 2015/0267195 A1 | 9/2015 | Seth et al. |
| 2015/0275212 A1 | 10/2015 | Albaek et al. |
| 2019/0382763 A1 | 12/2019 | Li et al. |

FOREIGN PATENT DOCUMENTS

| | | |
|---|---|---|
| WO | WO 2004/106356 | 12/2004 |
| WO | WO 2005/021570 | 3/2005 |
| WO | WO 2005/111233 | 11/2005 |
| WO | WO 2007/134181 | 11/2007 |
| WO | WO 2008/101157 | 8/2008 |
| WO | WO 2008/150729 | 12/2008 |
| WO | WO 2008/154401 | 12/2008 |
| WO | WO 2009/006478 | 1/2009 |
| WO | WO 2009/053050 | 4/2009 |
| WO | WO 2009/115478 | 9/2009 |
| WO | WO 2010/094732 | 8/2010 |
| WO | WO 2010/111702 | 9/2010 |
| WO | WO 2012/064758 | 5/2012 |
| WO | WO 2012/170947 | 12/2012 |
| WO | WO 2013/173637 | 11/2013 |
| WO | WO 2015/103339 | 7/2015 |
| WO | WO 2016/149331 | 9/2016 |
| WO | WO 2016/179342 | 11/2016 |
| WO | WO 2017/120397 | 7/2017 |
| WO | WO 2017/214112 | 12/2017 |
| WO | WO 2018/140920 | 8/2018 |
| WO | WO 2019/010342 | 1/2019 |
| WO | WO 2019/211585 | 11/2019 |
| WO | WO 2022/133278 | 6/2022 |

OTHER PUBLICATIONS

Altmann et al., "Second-generation antisense oligonucleoties: structure-activity relationships and the design of improved signal-transduction inhibitors" Biochem. Soc. Trans. (1996) 24: 630-637.

Altmann et al., "Second Generation of Antisense Oligonucleotides: From Nuclease Resistance to Biological Efficacy in Animals" Chimia (1996) 50: 168-176.

Altmann et al., "Second Generation Antisense Oligonucleotides—Inhibition of PKC-a and c-RAF Kinase Expression by Chimeric Oligonucleotides Incorporating 5'-Substituted Carbocyclic Nucleosides and 2'-O-Ethylene Glycol Substituted Ribonucleosides" Nucleosides Nucleotides (1997) 16(7-9): 917-926.

Altschul et al., "Basic Local Alignment Search Tool" J. Mol. Biol. (1990) 215: 403-410.

Anderson et al., "Towards next generation antisense oligonucleotides: mesylphosphoramidate modification improves therapeutic index and duration of effect of gapmer antisense oligonucleotides" Nucl Ac Res (2021) 49: 1-16.

Anderson et al., "Towards next generation antisense oligonucleotides-mesylphosphoramidate modification improves therapeutic index and duration of effect of gapmer antisense oligonucleotides" Presentation for 17th Annual Meeting of the Oligonucleotide Therapeutics Society OTS (Sep. 26-29, 2021).

Aulak et al., "Chymotrypsin inhibitory activity of normal C1-inhibitor and a P1 Arg to His mutant: evidence for the presence of overlapping reactive centers." Protein Sci. (1993) 2(5): 727-732.

Bennett et al., "Efficiency of Antisense Oligonucleotide Drug Discovery" Antisense & Nucleic Acid Drug Development (2002) 12: 215-224.

Bertina et al., "Mutation in blood coagulation factor V associated with resistance to activated protein C." Nature (1994) 369(6475):64-67.

Bhattacharjee et al., "Inhibition of Vascular Permeability by Antisense-Mediated Inhibition of Plasma Kallikrein and Coagulation Factor 12" Nucl Ac Res (2013) 23: 175-187.

Bhattacharjee et al., "Reversal of Vascular Permeability by Targeted Inhibition of Plasma Kallikrein and Factor XII" Presentation for FASEB Summer Research Conferences: Proteasesin Hemostasis and Vascular Biology (Jun. 12-17, 2011) Carefree, Arizona.

Bhattacharjee et al., "Reversal of Vascular Permeability by Targeted Inhibition of Plasma Kallikrein and Factor XII" Abstract for FASEB Summer Research Conferences: Proteasesin Hemostasis and Vascular Biology (Jun. 12-17, 2011) Carefree, Arizona.

Bjork et al., "Mechanism of the anticoagulant action of heparin." Mol Cell Biochem. (1982) 48(3): 161-182.

Bouillet et al. "Disease expression in women with hereditary angioedema" Am. J. Obstet. Gynecol. (2008) 199: 484.e1-484.e4.

Braasch et al., "Locked nucleic acid (LNA): fine-tuning the recognition of DNA and RNA" Chem. Biol. (2001) 8:1-7.

Branch et al., "A good antisense molecule is hard to find," TIBS (1998) 23:45-50.

Chan et al., "The inhibition of activated factor XII (hageman factor) by antithrombin III: The effect of other plasma proteinase inhibitors" Biochem. Biophys. Res. Comm. (1977) 74(1): 150-158.

Chen et al., "Depletion of coagulation factor XII ameliorates brain pathology and cognitive impairment in Alzheimer disease mice" Thrombosis and Hemostasis (2017) 129: 2547-2556.

Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

Cichon et al., "Increased activity of coagulation factor XII (Hageman factor) causes hereditary angioedema type III." Am. J. Hum. Genet. (2006) 79: 1098-1104.

Citarella et al., "The Second Exon-Encoded Factor XII Region Is Involved in the Interaction of Factor XII With Factor XI and Does Not Contribute to the Binding Site for Negatively Charged Surfaces" Blood (1998) 92: 4198-4206.

Citarella et al., "Identification of a putative binding site for negatively charged surfaces in the fibronectin type II domain of human factor XII—an immunochemical and homology modeling approach." Thromb. Haemost. (2000) 84(6): 1057-1065.

Crooke et al., "Basic Principles of Antisense Therapeutics" Antisense Research and Application (1998) Chapter 1:1-50.

Crooke, St., et al., "Antisense Drug Technology" Second Edition, CRC Press (2008) Chapters 1-28.

Crosby et al., "FXII Antisense Oligonucleotide Mediated Depletion Results in Effective Anticoagulation Without Bleeding Risk" Abstract for 52nd Annual Meeting and Exposition ASH—American Society of Hematology (Dec. 4-7, 2010) Orange County Conve.

Crosby et al., "FXII Antisense Oligonucleotide Mediated Depletion Results in Effective Anticoagulation Without Bleeding Risk" Presentation for 52nd Annual Meeting and Exposition ASH—American Society of Hematology (Dec. 4-7, 2010) Orange County Convention Center, Orlando FL.

Crosby et al., "Antisense Oligonucleotide Mediated Depletion of Factor XII Results in Effective Anticoagulation Without Bleeding" Abstract for 59th ASH Annual Meeting & Exposition (Dec. 9-12, 2017) Atlanta, GA.

Crosby et al., "Systematic Evaluation of Coagulation Factors as Targets for Anti-Thrombotic therapy using Antisense Technology" Abstract for 51st Annual Meeting American Society of Hematology (Dec. 5-8, 2009) New Orleans, Louisiana.

Crosby et al., "Antisense Oligonucletide Mediated Depletion of Plasma Kallikrein and Factor XII Results in Effective Anticoagulation without Bleeding Risk" Abstract for ATVB—Arteriosclerosis, Thrombosis and Vascular Biology 2011 Scientific Sessions (Apr. 28-30, 2011) Chicago, IL.

(56) References Cited

OTHER PUBLICATIONS

Cugno et al., "C1-inhibitor deficiency and angioedema: molecular mechanisms and clinical progress" Trends. Mol. Med. (2009) 15(2): 69-78.
Drake et al., "Selective cellular expression of tissue factor in human tissues. Implications for disorders of hemostasis and thrombosis." Am J Pathol (1989) 134(5):1087-1097.
Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.
Elayadi et al., "Applications of PNA and LNA oligomers to chemotherapy" Curr. Opinion Invest. Drugs (2001) 2:558-561.
Esnouf et al., "A monoclonal antibody raised against human beta-factor XIIa which also recognizes alpha-factor XIIa but not factor XII or complexes of factor XIIa with C1 esterase inhibitor." Thromb. Haemost. (2000) 83(6): 874-881.
Farsetti et al., "Orphan receptor hepatocyte nuclear factor-4 antagonizes estrogen receptor alpha-mediated induction of human coagulation factor XII gene." Endocrinology (1998) 139(11): 4581-4589.
Foster et al., "Inhibition of the activation of Hageman factor (factor XII) and of platelet aggregation by extracts of Brugia malayi microfilariae." J. Lab. Clin. Med. (1991) 117(5): 344-352.
Foster et al., "Inhibition of the activation of Hageman factor (factor XII) by extracts of Schistosoma mansoni." J. Lab. Clin. Med. (1992) 120(5): 735-739.
Freier et al., "The ups and downs of nucleic acid duplex stability: structure-stability studies on chemically-modified DNA:RNA duplexes" Nucleic Acids Research (1997) 25(22):4429-4443.
Frieden et al., "Expanding the design horizon of antisense oligonucleotides with alpha-L-LNA" Nucleic Acids Research (2003) 31(21):6365-6372.
Gautschi et al., "Activity of a Novel bcl-2/bcl-xL-Bispecific Antisense Oligonucleotide Against Tumors of Diverse Histologic Origins" J. Natl. Cancer Inst. (2001) 93(6):463-471.
Gigli et al., "Interaction of plasma kallikrein with the C1 inhibitor." J. Immunol. (1970) 104:574-581.
Han et al., "Increased vascular permeability in C1 inhibitor-deficient mice mediated by the bradykinin type 2 receptor." J. Clin. Invest. (2002) 109: 1057-1063.
Hazegh-Azam et al., "The Corn Inhibitor of Activated Hageman Factor: Purification and Properties of Two Recombinant Forms of the Protein" Protein Expr. Purif. (1998) 13(2): 143-149.
Hisada et al., "The Intrinsic Pathway does not Contribute to Activation of Coagulation in Mice Bearing Human Pancreatic Tumors Expressing Tissue Factor" Thromb Haemost (2021) 121: 967-970.
Hojima et al., "Pumpkin seed inhibitor of human factor XIIa (activated Hageman factor) and bovine trypsin" Biochemistry (1982) 21(16): 3741-3746.
Isawa et al., "Identification and characterization of plasma kallikrein-kinin system inhibitors from salivary glands of the blood-sucking insect Triatoma infestans." FEBS J. (2007) 274(16): 4271-4286.
Ivanov et al., "A mechanism for hereditary angioedema with normal C1 inhibitor: an inhibitory regulatory role for the factor XII heavy chain" Thrombosis and Hemostasis (2019) 133: 1152-1163.
Kaplan et al., "Pathways for bradykinin formation and inflammatory disease." J. Allergy Clin. Immunol. (2002) 109(2): 195-209.
Kato et al., "Identification and characterization of the plasma kallikrein-kinin system inhibitor, haemaphysalin, from hard tick, *Haemaphysalis longicornis*" Thromb. Haemost. (2005) 93: 359-67.
Kleinschnitz et al., "Targeting coagulation factor XII provides protection from pathological thrombosis in cerebral ischemia without interfering with hemostasis" J. Exper. Med. (2006) 203:513-518.
Kohler et al., "The contact system proteases play disparate roles in streptococcal sepsis" Haematologica (2020) 105: 1424-1435.
Koshkin et al., "LNA (Locked Nucleic Acids): Synthesis of the Adenine, Cytosine, Guanine, 5-Methylcytosine, Thymine and Uracil Biocyclonucleoside Monomers, Oligomerisation, and Unprecedented Nucleic Acid Recognition" Tetrahedron (1998) 54:3607-3630.
Kumar et al., "The First Analogues of LNA (Locked Nucleic Acids): Phosphorothioate-LNA and 2'-Thio-LNA" Bioorg. Med. Chem. Lett. (1998) 8:2219-2222.
Leumann, "DNA Analogues: From Supramolecular Principles to Biological Properties" Bioorganic & Medicinal Chemistry (2002) 10:841-854.
Mackenzie et al., "Plasma prekallikrein levels are positively associated with circulating lipid levels and the metabolic syndrome in children." Appl. Physiol. Nutr. Metab. (2010) 35: 518-525.
Mahdi et al., "Factor XII interacts with the multiprotein assembly of urokinase plasminogen activator receptor, gC1qR, and cytokeratin 1 on endothelial cell membranes" Blood (2002) 99(10): 3585-3596.
Maher et al., "Comparative hybrid arrest by tandem antisense oligodeoxyribonucleotides or oligodeoxyribonucleoside methylphosphonates in a cell-free system" Nuc. Acid. Res. (1988) 16:3341-3358.
Malik et al., "Ployphosphate-induced thrombosis in mice is factor XII dependent and is attenuated by histidine-rich glycoprotein" Blood Advances (2021) 5: 3540-3551.
Martin, "Ein neuer Zugang zu 2'-O-Alkylribonucleosiden und Eigenschaften eren Oligonucleotide" Helv. Chim. Acta (1995) 78: 486-504.
New England Biolabs 1998/99 Catalog (cover page and pp. 121 and 284).
Nielsen, "Corn trypsin inhibitor decreases tissue-type plasminogen activator-mediated fibrinolysis of human plasma." Blood Coagul. Fibronolysis. (2009) 20(3): 191-196.
Nishikawa et al., "Effect of neurotropin® on the activation of the plasma kallikrein-kinin system" Biochem. Pharmacol. (1992) 43(6): 1361-1369.
Niwano et al., "Inhibitory action of amyloid precursor protein against human Hageman factor (factor XII)." J. Lab. Clin. Med. (1995) 125(2): 251-256.
Orum et al., "Locked nucleic acids: A promising molecular family for gene-function analysis and antisense drug development" Curr. Opinion Mol. Ther. (2001) 3(3):239-243.
Pollack et al., "Mechanism Driven Early Stage Identification and Avoidance of Antisense Oligonucleotides Causing TRL9 Mediated Inflammatory Responses in Bjab cells" bioRxiv preprint (2021) https://doi.org/10.1101/2021.12.12.472280 : 1-25.
Rajapakse et al., "A novel anticoagulant purified from fish protein hydrolysate inhibits factor XIIa and platelet aggregation." Life Sci. (2005) 76(22): 2607-2619.
Ratnoff et al., "Inhibition of the activation of hageman factor (factor XII) by eosinophils and eosinophilic constituents" Am. J. Hematol. (1993) 42(1): 138-145.
Revenko et al., "Selective deletion of plasma prekallikrein or coagulation factor XII inhibits thrombosis in mice without increasing risk of bleeding" Thrombosis & Hemostatsis (2011) 118: 5302-5311.
Reynolds et al., "Rational siRNA design for RNA interference" Nature Biotechnology (2004) 22(3):326-330.
Ryder et al., "The effect of chemical modification of basic amino acid residues on the activation and amidolytic activity of Hageman factor (factor XII)." J. Lab. Clin. Med. (1993) 122(6): 697-702.
Sampaio et al., "Plant serine proteinase inhibitors. Structure and biochemical applications on plasma kallikrein and related enzymes." Immunopharmacology (1996) 32(1-3): 62-66.
Sanghvi et al., "Heterocyclic Base Modifications in Nucleic Acids and Their Applications in Antisense Oligonucleotides" Antisense Research and Applications (1993) pp. 273-288.
Schousboe et al., "Synchronized inhibition of the phospholipid mediated autoactivation of factor XII in plasma by beta 2-glycoprotein I and anti-beta 2-glycoprotein I." Thromb. Haemost (1995) 73(5): 798-804.
Schwartz et al., "Tissue factor pathway inhibitor endocytosis." Trends Cardiovasc Med. (1997) 7(7):234-239.
Scott et al., "Alpha-1-antitrypsin—Pittsburgh. A potent inhibitor of human plasma factor XIa, kallikrein, and factor XIIf." J. Clin. Invest. (1986) 77(2): 631-634.

(56) References Cited

OTHER PUBLICATIONS

Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.

Singh et al., "LNA (locked nucleic acids): synthesis and high-affinity nucleic acid recognition" Chem. Commun. (1998) 4:455-456.

Singh et al., "Synthesis of 2'-Amino-LNA: A Novel Conformationally Restricted High-Affinity Oligonucleotide Analogue with a Handle" J. Org. Chem. (1998) 63:10035-10039.

Slingsby et al., "Sequence-specific 2'-O-methoxyethyl antisense oligonucleotides activate human platelets through glycoprotein VI, triggering formation of platelet-leukocyte aggregates" Haematologica (2022) 107: 519-531.

Srivastava et al., "Five- and Six-Membered Conformationally Locked 2',4'-Carbocyclic ribo-Thymidines: Synthesis, Structure, and Biochemical Studies" J. Am. Che,. Soc. (2007) 129:8362-8379.

Stroo et al., "Inhibition of the extrinsic or intrinsic coagulation pathway during pneumonia-derived sepsis" Am J Physiol Lung Cell Mol Physiol (2018) 315: L799-L809.

Tanabe et al., "Isolation and Characterization of Streptoverticillium Anticoagulant (SAC), a Novel Protein Inhibitor of Blood Coagulation Produced by *Streptoverticillium cinnamoneum* subsp. *Cinnamoneum*" J. Biochem. (1994) 115(4): 743-751.

Vu et al., "Arterial thrombosis is accelerated in mice deficient in histidine-rich glycoprotein" Thrombosis and Hemostasis (2015) 125: 2712-2719.

Wahlestedt et al., "Potent and nontoxic antisense oligonucleoties containing locked nucleic acids" PNAS (2000) 97(10):5633-5638.

Woolf et al., "Specificity of antisense oligonucleotides in vivo" PNAS (1992) 89:7305-7309.

Yau et al., "Selective depletion of factor XI or factor XII with antisense oligonucleotides attenuates catheter thrombosis in rabbits" Blood (2014) 123(13):2102-2107.

Zhang e al., "PowerBLAST: A New Network BLAST Application for Interactive or Automate Sequence Analysis and Annoation", Genome Res. (1997) 7: 649-656.

Zhou et al., "Fine Tuning of Electrostatics around the Internucleoside Phosphate through Incorporation of Modified 2',4'-Carbocylic-LNAs and -ENAs Leads to Significant Modulation of Antisense Properties" J. Org. Chem. (2009) 74: 118-134.

Zuraw, "Hereditary Angioedema" N. Engl. J. Med. (2008) 359: 1027-36.

International Search Report for application PCT/US11/59804 dated May 14, 2012.

International Search Report for application PCT/US2012/041747 dated Dec. 10, 2012.

International Search Report for application PCT/US2021/064145 dated Jun. 8, 2022.

COMPOUNDS AND METHODS FOR MODULATING FACTOR XII

SEQUENCE LISTING

The present application is being filed along with a Sequence Listing in electronic format. The Sequence Listing is provided as a file entitled BIOL0369USEQ_ST25.txt, created on Dec. 8, 2021, which is 1 MB in size. The information in the electronic format of the sequence listing is incorporated herein by reference in its entirety.

FIELD

Provided herein are compounds, methods, and pharmaceutical compositions for reducing an amount of Factor XII (FXII) RNA in a cell or a subject, and in certain instances reducing the amount of FXII protein in a cell or a subject. Such compounds, methods, and pharmaceutical compositions are useful to treat or prevent a thromboembolic condition. Such thromboembolic conditions include myocardial infarction (MI), stroke, limb ischemia and necrosis, and venous thromboembolism (VTE), including deep vein thrombosis (DVT) and pulmonary embolism (PE).

BACKGROUND

The human F12 gene encodes FXII protein, a zymogen that circulates in the blood stream. The zymogen is converted to an active enzyme (FXIIa) by plasma kallikrein (PK) or by its unique ability to auto-activate following binding to artificial or biologic surfaces. In vivo, FXIIa triggers the kallikrein-kinin system leading to release of bradykinin (BK) which induces microvascular permeability, nitric oxide-mediated vasodilation, hypotension, and inflammatory reactions such as swelling, hyperperfusion, and pain. FXIIa also initiates coagulation via the intrinsic pathway and promotes inflammation via the kallikrein-kinin system comprising, high molecular weight kininogen (HK) and PK.

FXII may contribute to a variety of inflammatory, life-threatening disease conditions, including hereditary angioedema (HAE) and thrombosis. HAE is a rare life-threatening inherited disorder characterized by recurrent episodes of acute swelling in multiple organs because of increased vascular permeability. An excess of FXII activity may trigger excessive BK formation or signaling, thereby contributing to the vascular permeability of hereditary angioedema. Thrombosis is a maladaptive process of vascular occlusion and remains a primary cause of vascular morbidity and mortality associated with myocardial infarction (MI), stroke, limb ischemia and necrosis, and venous thromboembolism (VTE), including deep vein thrombosis (DVT) and pulmonary embolism (PE). VTE is the third leading cause of vascular-related death, after MI and stroke, and is one of the leading causes of death in patients with cancer. While many thromboembolic conditions are due to acquired extrinsic issues, (e.g. surgery, cancer, immobility), other thromboembolic conditions are due to a genetic mutation, (e.g., antiphospholipid syndrome, Factor V Leiden thrombophilia). The most commonly used treatments for thromboembolic conditions (e.g., warfarin, heparin) and newer direct oral anticoagulants all possess significant drawbacks, such as an increased risk of bleeding. It is therefore an object herein to provide compounds, methods, and pharmaceutical compositions for the treatment and prevention of such thromboembolic conditions.

SUMMARY OF THE INVENTION

Provided herein are compounds, methods and pharmaceutical compositions for reducing an amount of FXII RNA, and in certain embodiments reducing the amount or activity of FXII protein in a cell or a subject. In certain embodiments, compounds, methods and pharmaceutical compositions disclosed herein reduce FXII RNA, FXII protein, FXII activity, or a combination thereof, in the blood of a subject. In certain embodiments, the subject has or is at risk for a thromboembolic condition. In certain embodiments, the thromboembolic condition is deep vein thrombosis, venous thrombosis, arterial thrombosis, pulmonary embolism, myocardial infarction, or stroke. In certain embodiments, compounds useful for reducing the amount of FXII RNA, the amount of FXII protein, or FXII activity are oligomeric compounds. In certain embodiments, oligomeric compounds comprise modified oligonucleotides.

Also provided are herein are methods useful for preventing a thromboembolic condition and methods useful for ameliorating a symptom of a thromboembolic condition. Exemplary symptoms of a thromboembolic condition include, but are not limited to, pain, shortness of breath, heart burn, cold sweat, fatigue, lightheadedness, dizziness, swelling, cramping, and death.

Also provided are herein are methods useful for treating hereditary angioedema and methods useful for ameliorating a symptom of hereditary angioedema. Exemplary symptoms of hereditary angioedema include, but are not limited to, swelling, nausea, vomiting, itching, headache, fatigue, abdominal pain, shortness of breath, rhinitis, anaphylaxis, and bronchoconstriction.

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated-by-reference for the portions of the document discussed herein, as well as in their entirety.

Definitions

Unless specific definitions are provided, the nomenclature used in connection with, and the procedures and techniques of, analytical chemistry, synthetic organic chemistry, and medicinal and pharmaceutical chemistry described herein are those well-known and commonly used in the art. Where permitted, all patents, applications, published applications and other publications and other data referred to throughout in the disclosure are incorporated by reference herein in their entirety.

Unless otherwise indicated, the following terms have the following meanings:

Definitions

As used herein, "2'-deoxynucleoside" means a nucleoside comprising a 2'-H(H) deoxyribosyl sugar moiety. In certain embodiments, a 2'-deoxynucleoside is a 2'-β-D-deoxynucleoside and comprises a 2'-β-D-deoxyribosyl sugar moiety, which has the β-D configuration as found in naturally occurring deoxyribonucleic acids (DNA). In certain embodiments, a 2'-deoxynucleoside may comprise a modified nucleobase or may comprise an RNA nucleobase (uracil).

As used herein, "2'-MOE" or "2'-MOE sugar moiety" means a 2'-OCH$_2$CH$_2$OCH$_3$ group in place of the 2'-OH group of a ribosyl sugar moiety. "MOE" means methoxyethyl. Unless otherwise indicated, a 2'-MOE has the β-D stereochemical configuration.

As used herein, "2'-MOE nucleoside" means a nucleoside comprising a 2'-MOE sugar moiety.

As used herein, "2'-OMe" or "2'-O-methyl sugar moiety" means a 2'-OCH$_3$ group in place of the 2'-OH group of a ribosyl sugar moiety. Unless otherwise indicated, a 2'-OMe has the β-D stereochemical configuration.

As used herein, "2'-OMe nucleoside" means a nucleoside comprising a 2'-OMe sugar moiety.

As used herein, "2'-substituted nucleoside" means a nucleoside comprising a 2'-substituted sugar moiety. As used herein, "2'-substituted" in reference to a sugar moiety means a sugar moiety comprising at least one 2'-substituent group other than H or OH.

As used herein, "5-methyl cytosine" means a cytosine modified with a methyl group attached to the 5 position. A 5-methyl cytosine is a modified nucleobase.

As used herein, "administering" means providing a pharmaceutical agent to a subject.

As used herein, "ameliorate" in reference to a treatment means improvement in at least one symptom relative to the same symptom in the absence of the treatment. In certain embodiments, amelioration is the reduction in the severity or frequency of a symptom or the delayed onset or slowing of progression in the severity or frequency of a symptom.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, "antisense compound" means an oligomeric compound capable of achieving at least one antisense activity.

As used herein, "bicyclic nucleoside" or "BNA" means a nucleoside comprising a bicyclic sugar moiety.

As used herein, "bicyclic sugar" or "bicyclic sugar moiety" means a modified sugar moiety comprising two rings, wherein the second ring is formed via a bridge connecting two of the atoms of the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

As used herein, "cell-targeting moiety" means a conjugate moiety that interacts with a cell or a portion thereof. In certain embodiments, the cell-targeting moiety binds a receptor on a surface of a cell.

As used herein, "cEt nucleoside" means a nucleoside comprising a cEt modified sugar moiety.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

As used herein, "cleavable moiety" means a bond or group of atoms that is cleaved under physiological conditions, for example, inside a cell, a subject, or a human.

As used herein, "complementary" in reference to an oligonucleotide means that at least 70% of the nucleobases of the oligonucleotide or one or more portions thereof and the nucleobases of a target nucleic acid or one or more portions thereof are capable of hydrogen bonding with one another when the nucleobase sequence of the oligonucleotide and the other nucleic acid are aligned in opposing directions. As used herein, complementary nucleobases means nucleobases that are capable of forming hydrogen bonds with one another. Complementary nucleobase pairs include adenine (A) and thymine (T), adenine (A) and uracil (U), cytosine (C) and guanine (G), 5-methyl cytosine (mC) and guanine (G). Complementary oligonucleotides and/or target nucleic acids need not have nucleobase complementarity at each nucleoside. Rather, some mismatches are tolerated. As used herein, "fully complementary" or "100% complementary" in reference to an oligonucleotide, or portion thereof, means that the oligonucleotide, or portion thereof, is complementary to another oligonucleotide or target nucleic acid at each nucleobase of the shorter of the two oligonucleotides, or at each nucleoside if the oligonucleotides are the same length.

As used herein, "conjugate group" means a group of atoms that is directly or indirectly attached to an oligonucleotide. Conjugate groups include a conjugate moiety and a conjugate linker that attaches the conjugate moiety to the oligonucleotide. In certain embodiments, the conjugate moiety comprises a cell-targeting moiety.

As used herein, "conjugate linker" means a single bond or a group of atoms comprising at least one bond that connects a conjugate moiety to an oligonucleotide.

As used herein, "conjugate moiety" means a group of atoms that is attached to an oligonucleotide via a conjugate linker.

As used herein, "constrained ethyl" or "cEt" or "cEt modified sugar moiety" means a β-D ribosyl bicyclic sugar moiety wherein the second ring of the bicyclic sugar is formed via a bridge connecting the 4'-carbon and the 2'-carbon of the β-D ribosyl sugar moiety, wherein the bridge has the formula 4'-CH(CH$_3$)—O-2', and wherein the methyl group of the bridge is in the S configuration.

As used herein, "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein, "FXII RNA" is the RNA expression product of a human F12 gene.

As used herein, "FXII protein" is the protein expression product of a FXII RNA, including zymogen and activated forms FXII protein.

As used herein, "gapmer" means an oligonucleotide having a central region positioned between a 5'-region and a 3'-region. Each nucleoside of the 5'-region and the 3'-region comprises a modified sugar moiety. The 3'- and 5'-most nucleosides of the central region are 2'-deoxynucleosides. The "central region" may be referred to as a "gap", and the "5'-region" and "3'-region" may also be referred to as a "wing." The hybridization of a gapmer to a target nucleic acid results in RNase H mediated cleavage of the target nucleic acid.

As used herein, "hotspot region" is a range of nucleobases on a target nucleic acid that is amenable to oligomeric compound-mediated reduction of the amount or activity of the target nucleic acid.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein, "identifying a subject at risk for developing a thromboembolic condition" means identifying a subject having been diagnosed with a thromboembolic condition or identifying a subject that has a risk factor for developing a thromboembolic condition.

As used herein, "internucleoside linkage" means the covalent linkage between contiguous nucleosides in an oligonucleotide. As used herein, "modified internucleoside linkage" means any internucleoside linkage other than a phosphodiester internucleoside linkage. "Phosphorothioate internucleoside linkage" is a modified internucleoside linkage in which one of the non-bridging oxygen atoms of a phosphodiester internucleoside linkage is replaced with a sulfur atom.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "mismatch" or "non-complementary" means a nucleobase of a first oligonucleotide that is not complementary with the corresponding nucleobase of a second oligonucleotide or target nucleic acid when the first and second oligonucleotide are aligned.

As used herein, "motif" means the pattern of unmodified and/or modified sugar moieties, nucleobases, and/or internucleoside linkages, in an oligonucleotide.

As used herein, "non-bicyclic modified sugar moiety" means a modified sugar moiety that comprises a modification, such as a substituent, that does not form a bridge between two atoms of the sugar to form a second ring.

As used herein, "nucleobase" means an unmodified nucleobase or a modified nucleobase. As used herein an "unmodified nucleobase" is adenine (A), thymine (T), cytosine (C), uracil (U), or guanine (G). As used herein, a "modified nucleobase" is a group of atoms other than unmodified A, T, C, U, or G capable of pairing with at least one unmodified nucleobase. A "5-methyl cytosine" is a modified nucleobase. A universal base is a modified nucleobase that can pair with any one of the five unmodified nucleobases. As used herein, "nucleobase sequence" means the order of contiguous nucleobases in a target nucleic acid or oligonucleotide independent of any sugar or internucleoside linkage modification.

As used herein, "nucleoside" means a compound comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a contiguous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to a subject. Certain such carriers enable pharmaceutical compositions to be formulated as, for example, tablets, pills, dragees, capsules, liquids, gels, syrups, slurries, suspension and lozenges for the oral ingestion by a subject. In certain embodiments, a pharmaceutically acceptable carrier or diluent is sterile water, sterile saline, or sterile buffer solution. In certain embodiments, a pharmaceutically acceptable carrier or diluent is phosphate buffered saline.

As used herein, "pharmaceutically acceptable salts" means physiologically and pharmaceutically acceptable salts of compounds. Pharmaceutically acceptable salts retain the desired biological activity of the parent compound and do not impart undesired toxicological effects thereto.

As used herein, "pharmaceutical composition" means a mixture of substances suitable for administering to a subject. For example, a pharmaceutical composition may comprise an oligomeric compound and a sterile aqueous solution. In certain embodiments, a pharmaceutical composition shows activity in free uptake assay in certain cell lines.

As used herein, "prevent" or "preventing" refers to delaying or forestalling the onset or development of a thromboembolic condition for a period of time or indefinitely.

As used herein, "prodrug" means a therapeutic agent in a form outside the body that is converted to a different form within a subject or cells thereof. Typically, conversion of a prodrug within the subject is facilitated by the action of an enzymes (e.g., endogenous or viral enzyme) or chemicals present in cells or tissues and/or by physiologic conditions.

As used herein, "reducing the amount or activity," or "inhibiting the amount or activity," in connection with a gene transcript (RNA) refers to a reduction or blockade of the transcriptional expression or activity relative to the transcriptional expression or activity in an untreated or control sample and does not necessarily indicate a total elimination of transcriptional expression or activity.

As used herein, "reducing the amount or activity," or "inhibiting the amount or activity," in connection with a protein refers to a reduction or blockade of the protein's expression or activity relative to the protein expression or activity in an untreated or control sample and does not necessarily indicate a total elimination of protein expression or activity.

As used herein, "RNA" means an RNA transcript and includes pre-mRNA and mature mRNA unless otherwise specified.

As used herein, "RNAi compound" means an antisense compound that acts, at least in part, through RISC or Ago2 to modulate a target nucleic acid and/or protein encoded by a target nucleic acid. RNAi compounds include, but are not limited to double-stranded siRNA, single-stranded RNA (ssRNA), and microRNA, including microRNA mimics. In certain embodiments, an RNAi compound modulates the amount, activity, and/or splicing of a target nucleic acid. The term RNAi compound excludes antisense compounds that act through RNase H.

As used herein, "self-complementary" in reference to an oligonucleotide means an oligonucleotide that at least partially hybridizes to itself.

As used herein, "standard cell assay" means the assay described in Example 1 and reasonable variations thereof.

As used herein, "stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

As used herein, "subject" means a human or non-human subject.

As used herein, "sugar moiety" means an unmodified sugar moiety or a modified sugar moiety. As used herein, "unmodified sugar moiety" means a 2'-OH(H) β-D-ribosyl moiety, as found in RNA (an "unmodified RNA sugar moiety"), or a 2'-H(H) β-D-deoxyribosyl sugar moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or target nucleic acids.

As used herein, "symptom" means any physical feature or test result that indicates the existence or extent of a disease or disorder. In certain embodiments, a symptom is apparent to a subject or to a medical professional examining or testing said subject.

As used herein, "target nucleic acid" and "target RNA" mean a nucleic acid that an antisense compound is designed to affect.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent that provides a therapeutic benefit to a subject. For example, a therapeutically effective amount improves a symptom of a disease.

As used herein, "thromboembolic condition" means any disease or condition involving a thrombosis or an embolism. A thrombosis is a pathological development of a blood clot, and an embolism occurs when the blood clot migrates to another part of the body and interferes with organ function. Conditions in which a thrombosis and/or an embolism occur are collectively referred to as a thromboembolic condition. Depending on where the blood clot occurs or settles, it may result in a variety of thromboembolic conditions, e.g., deep vein thrombosis (DVT), myocardial infarction (MI), pulmonary embolism (PE), and stroke. In certain embodiments, the thromboembolic condition comprises deep vein thrombosis, venous thrombosis, arterial thrombosis, pulmonary embolism, myocardial infarction, or stroke. Thromboembolic conditions may also be referred to as thromboembolic events or thrombotic events.

Certain Embodiments

The present disclosure provides the following non-limiting numbered embodiments:

Embodiment 1. An oligomeric compound comprising a modified oligonucleotide consisting of 12 to 50 linked nucleosides wherein the nucleobase sequence of the modified oligonucleotide is at least 90% complementary to an equal length portion of a FXII RNA, and wherein the modified oligonucleotide comprises at least one modification selected from a modified sugar moiety and a modified internucleoside linkage.

Embodiment 2. An oligomeric compound comprising a modified oligonucleotide consisting of 12 to 50 linked nucleosides and having a nucleobase sequence comprising at least 12, 13, 14, 15, 16, 17, 18, 19, or 20 contiguous nucleobases of any of SEQ ID NOs: 20-5042.

Embodiment 3. An oligomeric compound comprising a modified oligonucleotide consisting of 12 to 50 linked nucleosides and having a nucleobase sequence comprising at least 12, 13, 14, 15, 16, 17, or 18 contiguous nucleobases of any of SEQ ID NOs: 3379 and 5006.

Embodiment 4. An oligomeric compound comprising a modified oligonucleotide consisting of 12 to 50 linked nucleosides and having a nucleobase sequence comprising at least 8, at least 9, at least 10, at least 11, at least 12, at least 13, at least 14, at least 15, at least 16, at least 17, at least 18, at least 19, or at least 20 contiguous nucleobases complementary to: an equal length portion of nucleobases 1,899-1,979 of SEQ ID NO: 1; or an equal length portion of nucleobases 2,004-2,045 of SEQ ID NO: 1.

Embodiment 5. An oligomeric compound comprising a modified oligonucleotide consisting of 12 to 50 linked nucleosides and having a nucleobase sequence comprising at least 8, at least 9, at least 10, at least 11, at least 12, at least 13, at least 14, at least 15, at least 16, at least 17, or at least 18 contiguous nucleobases of a sequence selected from: SEQ ID NOs: 92, 156, 270, 271, 345, 346, 420, 421, 496, 497, 571, 572, 653, 654, 728, 729, 802, 803, 877, 951, 1028, 1103, 1179, 1253, 1330, 1407, 1484, 1560, 1636, 1710, 1711, 1784, 1859, 1860, 1934, 1935, 2008, 2009, 2084, 2085, 2158, 2232, 2233, 2307, 2308, 2393, 2394, 2395, 2396, 2397, 2398, 2461, 2537, 2538, 2614, 2615, 2691, 2692, 2768, 2769, 2845, 2846, 2921, 2922, 2997, 2998, 3073, 3074, 3144, 3145, 3226, 3227, 3303, 3304, 3379, 3380, 3455, 3456, 3531, 3607, 3683, 3759, 3835, 3911, 4948, 4949, 4954, 4955, 4956, 4957, 4961, 4965, 4966, 4967, 4971, 4972, 4976, 4994, 4995, 4996, 4997, 4998, 4999, 5024, 5025, 5026, 5027, 5028, and 5029; or SEQ ID NOs: 95, 159, 162, 163, 164, 165, 347, 422, 498, 573, 953, 1030, 1105, 1255, 1332, 1409, 1486, 1562, 2309, 2463, 2540, 2617, 2694, 2771, 2848, 2924, 3000, 3076, 3147, 3229, 3306, 3382, 3457, 3533, 3609, 3685, 3761, 3837, 3913, 5000, 5001, 5002, 5003, 5004, 5005, 5006, 5031, 5032, 5033, 5034, 5035, 5036, and 5037.

Embodiment 6. The oligomeric compound of any of embodiments 1-5, wherein the modified oligonucleotide has a nucleobase sequence that is at least 80%, 85%, 90%, 95%, or 100% complementary to the nucleobase sequence of any one of SEQ ID NOS: 1-4 when measured across the entire nucleobase sequence of the modified oligonucleotide.

Embodiment 7. The oligomeric compound of any of embodiments 1-6, wherein the modified oligonucleotide comprises at least one modified nucleoside.

Embodiment 8. The oligomeric compound of embodiment 7, wherein the modified oligonucleotide comprises at least one modified nucleoside comprising a modified sugar moiety.

Embodiment 9. The oligomeric compound of embodiment 8, wherein the modified oligonucleotide comprises at least one modified nucleoside comprising a bicyclic sugar moiety.

Embodiment 10. The oligomeric compound of embodiment 9, wherein the modified oligonucleotide comprises at least one modified nucleoside comprising a bicyclic sugar moiety having a 2'-4' bridge, wherein the 2'-4' bridge is selected from —O—CH$_2$—; and —O—CH(CH$_3$)—.

Embodiment 11. The oligomeric compound of any of embodiments 8-10, wherein the modified oligonucleotide comprises at least one modified nucleoside comprising a non-bicyclic modified sugar moiety.

Embodiment 12. The oligomeric compound of embodiment 11, wherein the non-bicyclic modified sugar moiety is a 2'-MOE sugar moiety or 2'-OMe sugar moiety.

Embodiment 13. The oligomeric compound of any of embodiments 7-8, wherein the modified oligonucleotide comprises at least one modified nucleoside comprising a sugar surrogate.

Embodiment 14. The oligomeric compound of any of embodiments 1-13, wherein the modified oligonucleotide is a gapmer.

Embodiment 15. The oligomeric compound of any of embodiments 1-14, wherein the modified oligonucleotide has a sugar motif comprising: a 5'-region consisting of 1-6 linked 5'-region nucleosides; a central region consisting of 6-10 linked central region nucleosides; and a 3'-region consisting of 1-6 linked 3'-region nucleosides, wherein each of the 5'-region nucleosides and each of the 3'-region nucleosides comprises a modified sugar moiety and each of the central region nucleosides comprises a 2'-β-D-deoxyribosyl sugar moiety.

Embodiment 16. The oligomeric compound of embodiment 15, wherein the 5'-region consists of 3 linked 5'-region nucleosides; the central region consists of 10 linked central region nucleosides; and the 3'-region consists of 3 linked 3'-region nucleosides, and wherein each of the 5'-region nucleosides and each of the 3'-region nucleosides comprises a cEt modified sugar moiety.

Embodiment 17. The oligomeric compound of any of embodiments 1-16, wherein the modified oligonucleotide comprises at least one modified internucleoside linkage.

Embodiment 18. The oligomeric compound of embodiment 17, wherein each internucleoside linkage of the modified oligonucleotide is a modified internucleoside linkage.

Embodiment 19. The oligomeric compound of embodiment 17 or 18, wherein each internucleoside linkage is a phosphorothioate internucleoside linkage.

Embodiment 20. The oligomeric compound of embodiment 17 or 18, wherein the modified oligonucleotide comprises at least one phosphodiester internucleoside linkage.

Embodiment 21. The oligomeric compound of embodiment 17, wherein each internucleoside linkage is independently selected from a phosphodiester internucleoside linkage and a phosphorothioate internucleoside linkage.

Embodiment 22. The oligomeric compound of any of embodiments 1-21, wherein the modified oligonucleotide comprises a modified nucleobase.

Embodiment 23. The oligomeric compound of embodiment 22, wherein the modified nucleobase is a 5-methyl cytosine.

Embodiment 24. The oligomeric compound of any of embodiments 1-23, wherein the modified oligonucleotide consists of 12-30, 12-22, 12-20, 14-18, 14-20, 15-17, 15-25, 16-20, 18-22 or 18-20 linked nucleosides.

Embodiment 25. The oligomeric compound of any of embodiments 1-23, wherein the modified oligonucleotide consists of 16 linked nucleosides.

Embodiment 26. The oligomeric compound of any of embodiments 1-25, consisting of the modified oligonucleotide.

Embodiment 27. The oligomeric compound of any of embodiments 1-25, comprising a conjugate group comprising a conjugate moiety and a conjugate linker.

Embodiment 28. The oligomeric compound of embodiment 27, wherein the conjugate linker consists of a single bond.

Embodiment 29. The oligomeric compound of embodiment 27, wherein the conjugate linker is cleavable.

Embodiment 30. The oligomeric compound of embodiment 27, wherein the conjugate linker comprises 1-3 linker-nucleosides.

Embodiment 31. The oligomeric compound of 27, wherein the oligomeric compound does not comprise a linker-nucleoside.

Embodiment 32. The oligomeric compound of any of embodiments 28-31, wherein the conjugate group is attached to the modified oligonucleotide at the 5'-end of the modified oligonucleotide.

Embodiment 33. The oligomeric compound of any of embodiments 28-31, wherein the conjugate group is attached to the modified oligonucleotide at the 3'-end of the modified oligonucleotide.

Embodiment 34. The oligomeric compound of any of embodiments 1-33, comprising a terminal group.

Embodiment 35. The oligomeric compound of any one of embodiments 1-34, wherein the conjugate group comprises a GalNAc moiety.

Embodiment 36. The oligomeric compound of anyone of embodiments 1-35, wherein the conjugate group comprises a cell-targeting moiety, a conjugate linker and a cleavable moiety, and wherein the cell-targeting moiety and the conjugate linker together have the following chemical structure:

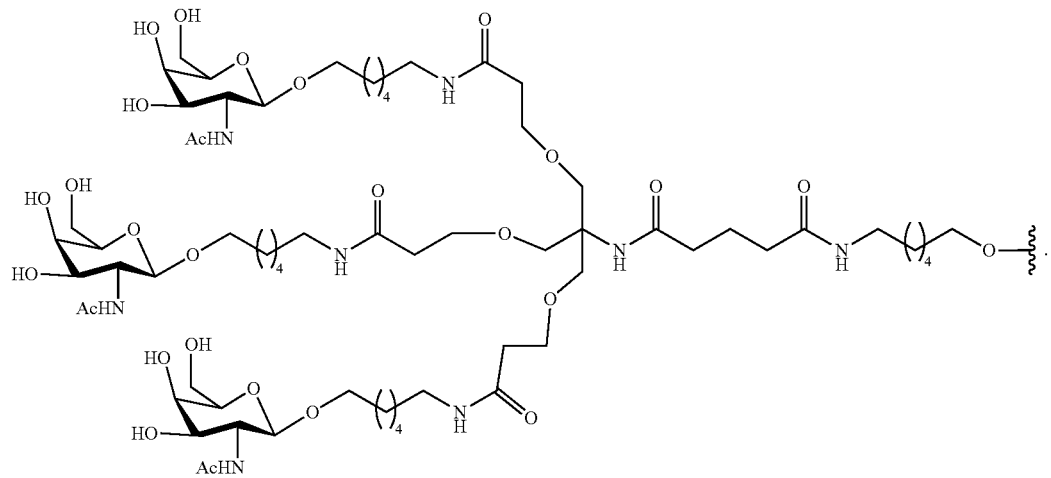

Embodiment 37. The oligomeric compound of any of embodiments 1-36, wherein the modified oligonucleotide is a single-stranded modified oligonucleotide.
Embodiment 38. An oligomeric compound according to the following chemical structure:
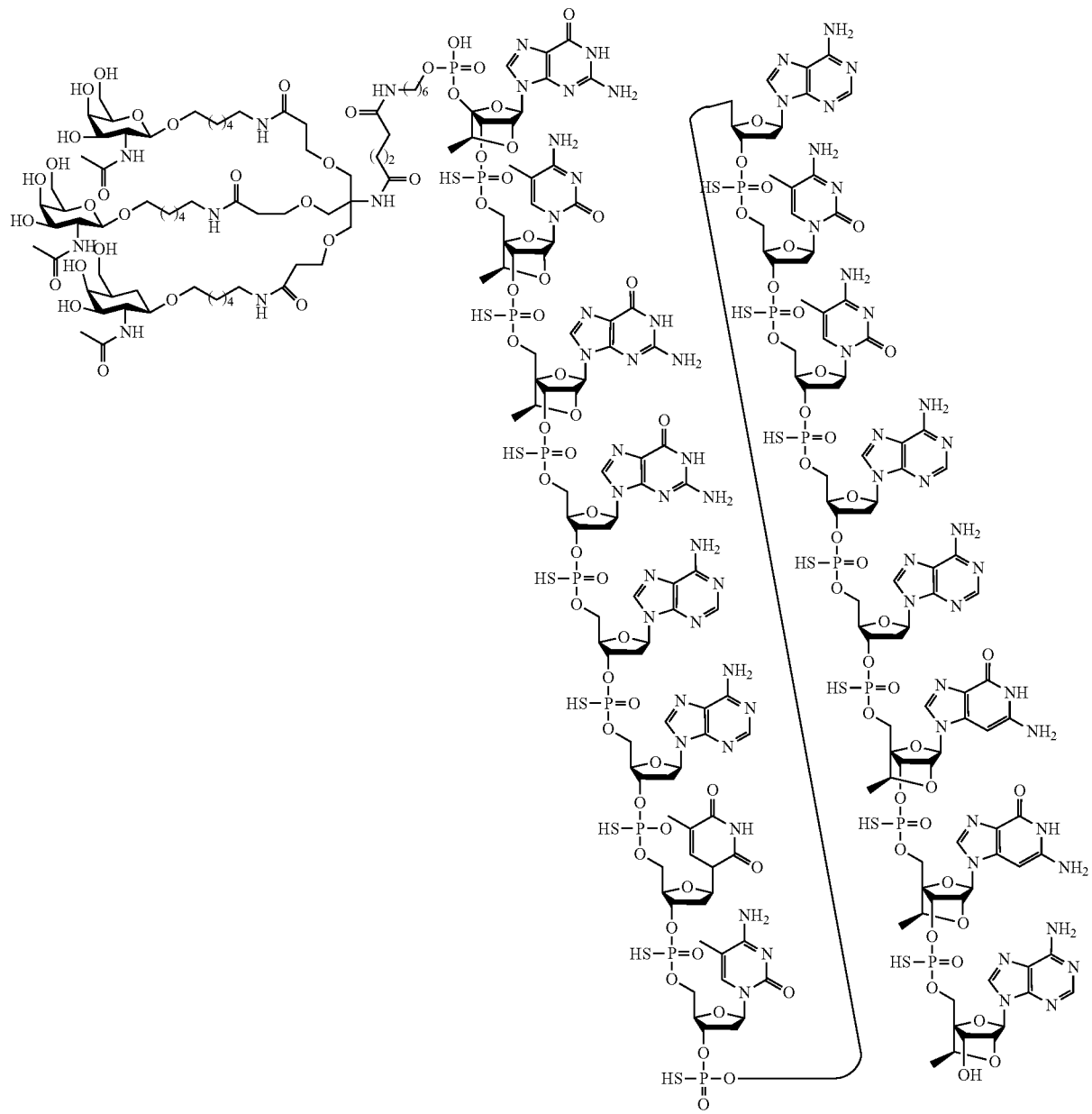
(SEQ ID NO: 3379), or a salt thereof.
Embodiment 39. The oligomeric compound of embodiment 38, which is the sodium salt or the potassium salt.

Embodiment 40. An oligomeric compound according to the following chemical structure:
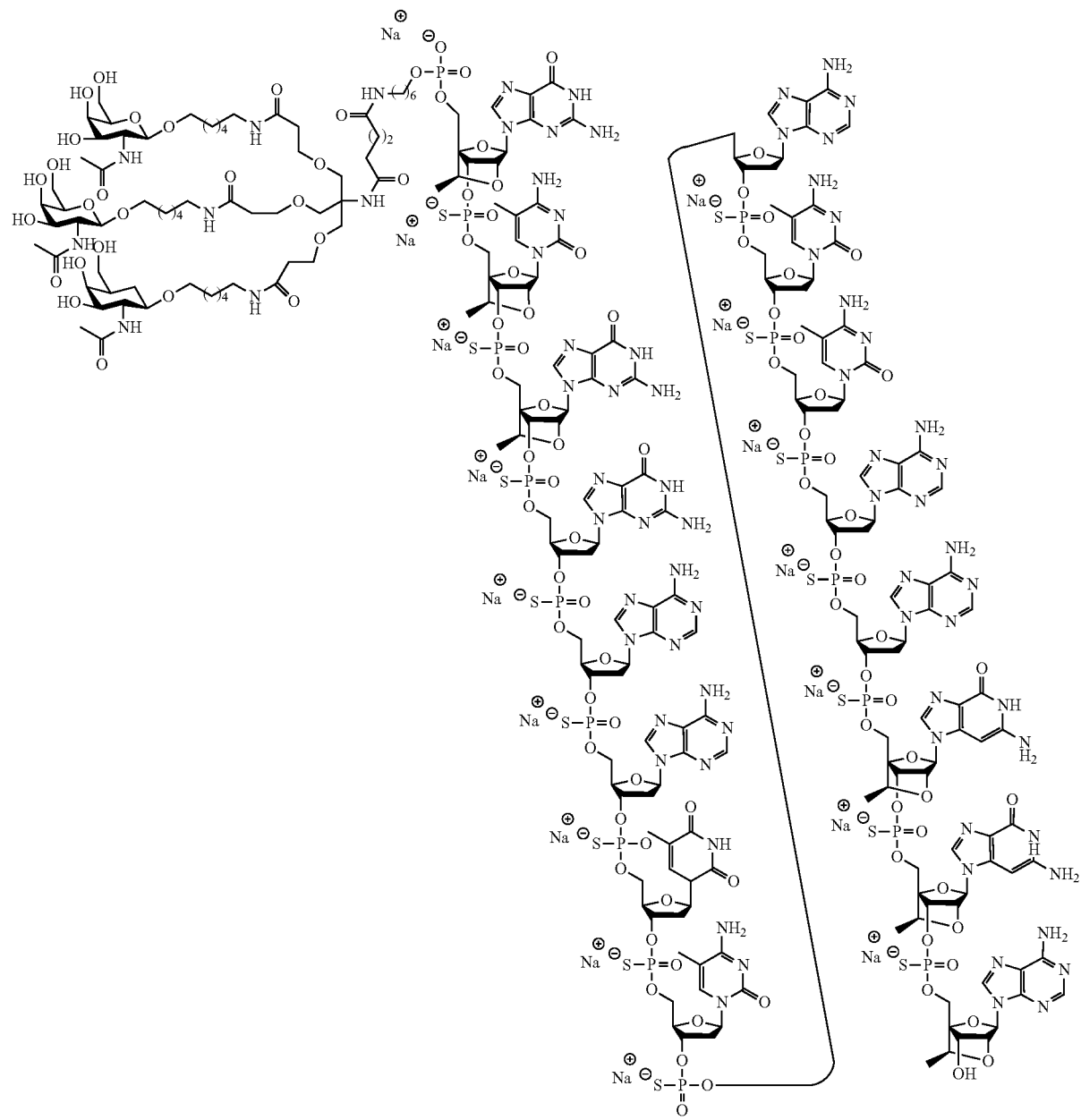
(SEQ ID NO: 3379).
Embodiment 41. An oligomeric compound according to the following chemical structure:

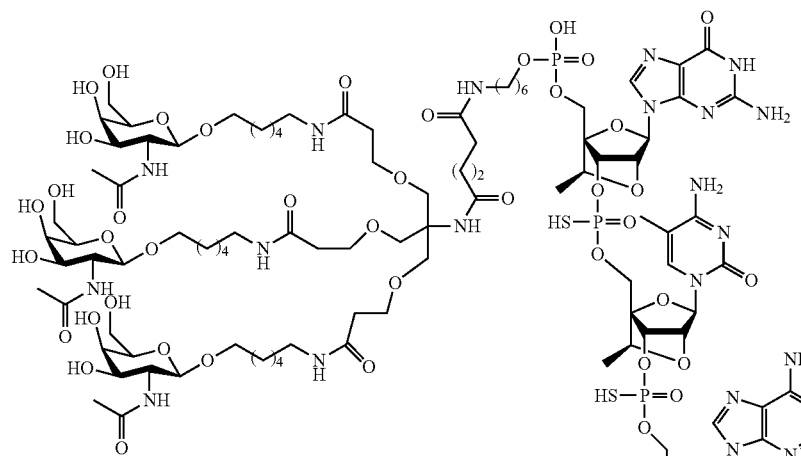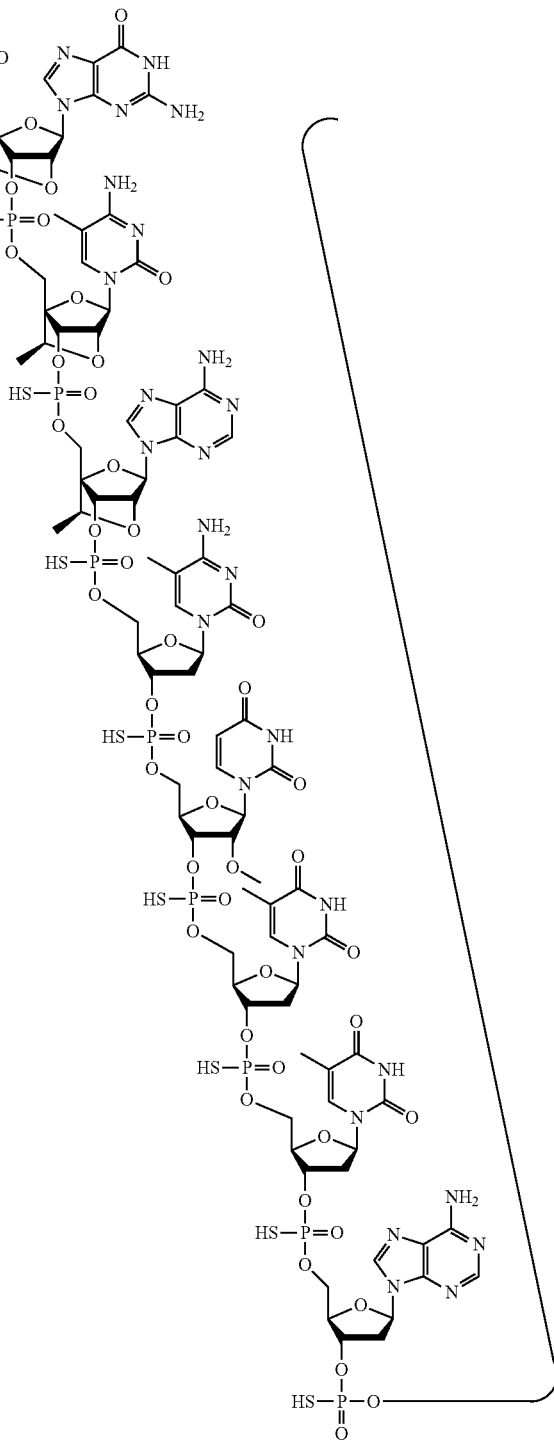

-continued
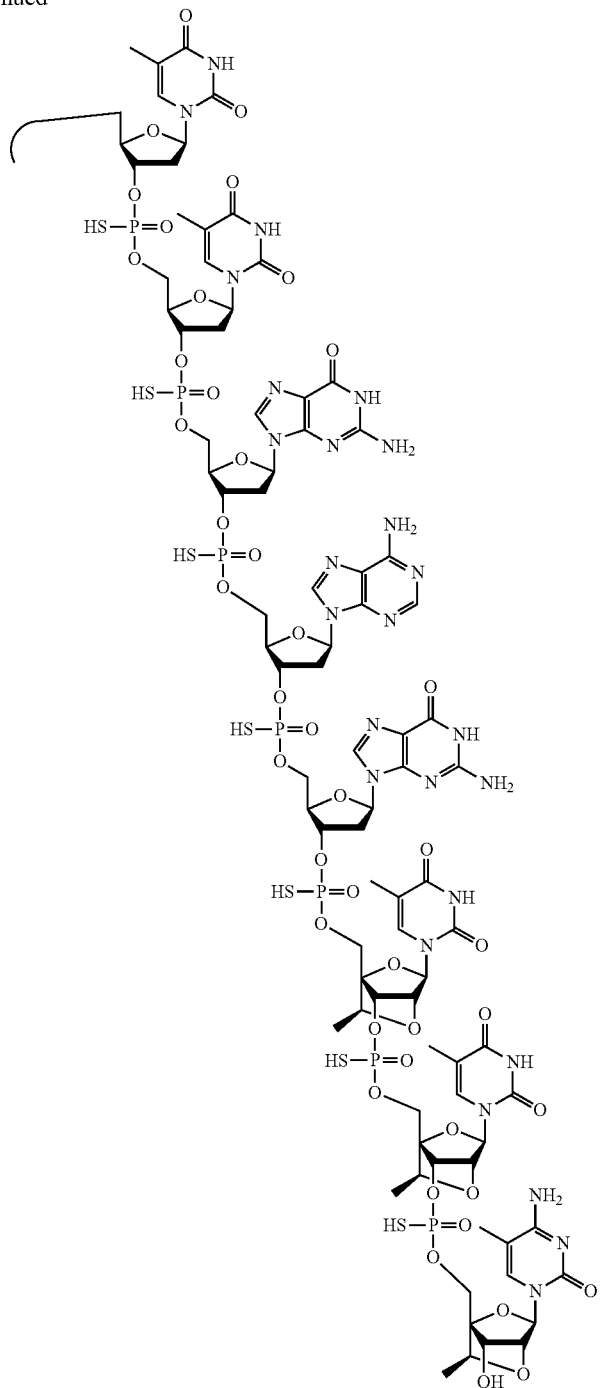
(SEQ ID NO: 5006), or a salt thereof.
Embodiment 42. The oligomeric compound of embodiment 41, which is the sodium salt or the potassium salt.

Embodiment 43. An oligomeric compound according to the following chemical structure:
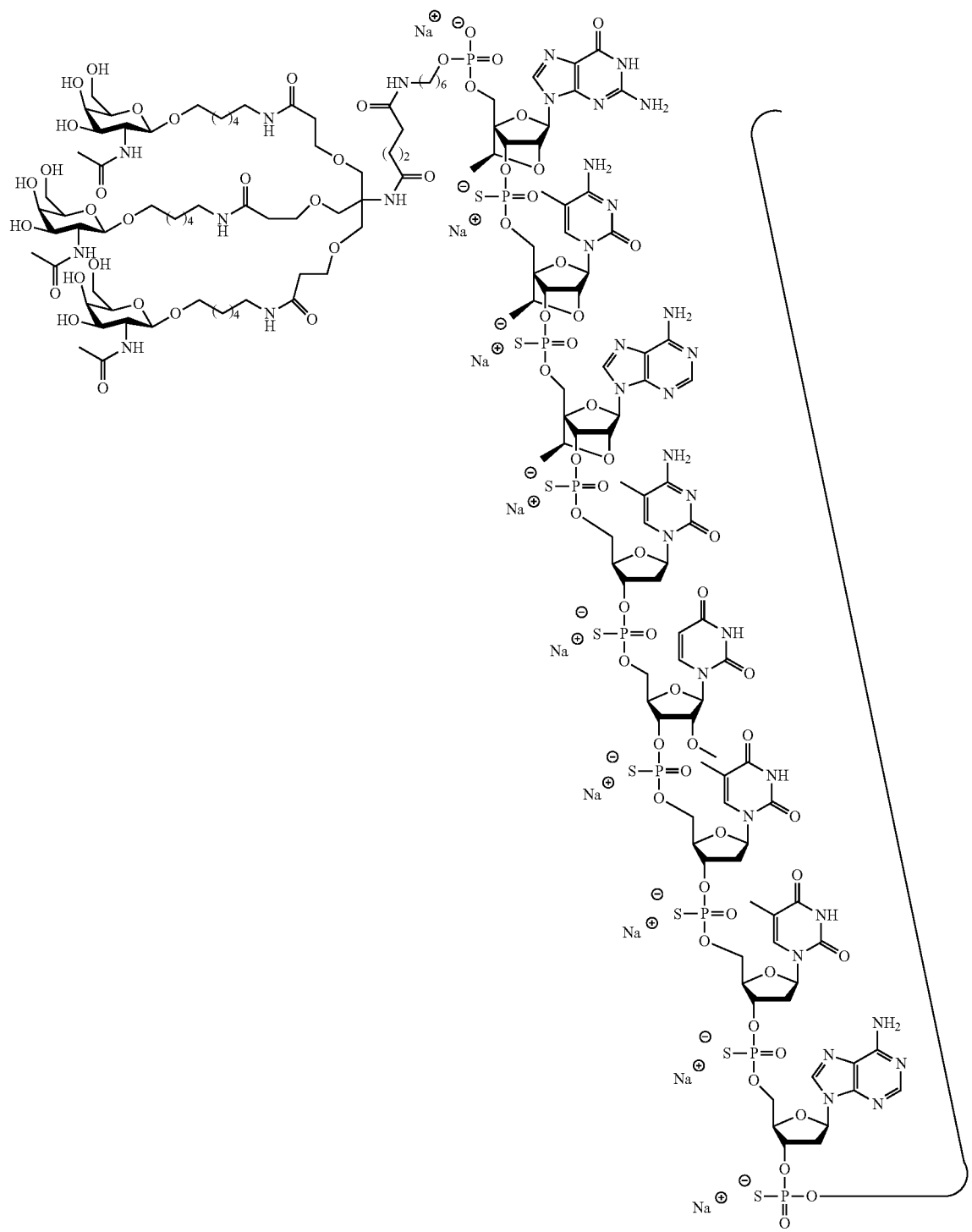

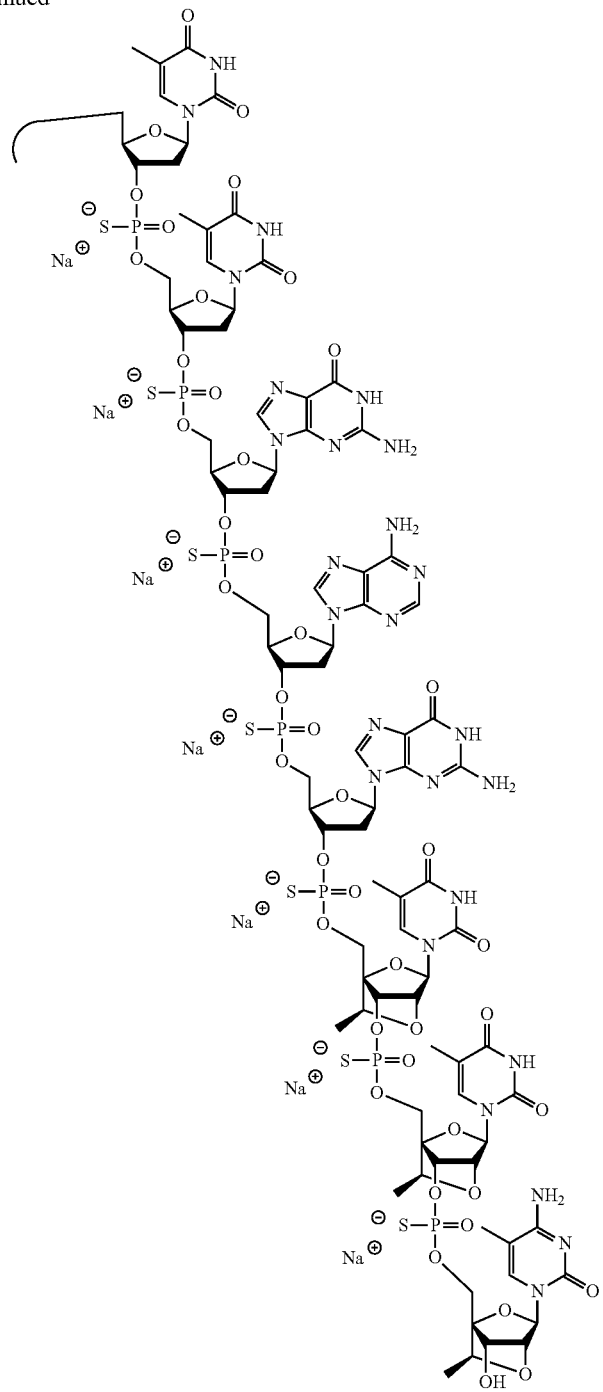

(SEQ ID NO: 5006).

Embodiment 44. An oligomeric compound comprising a modified oligonucleotide according to the following chemical notation: (THA-GalNAc₃)o Gks $^m$Cks Gks Gds Ads Ads Tds $^m$Cds Ads $^m$Cds $^m$Cds Ads Ads Gks Gks Ak (SEQ ID NO: 3379), wherein:
- A=an adenine nucleobase,
- mC=a 5-methyl cytosine nucleobase,
- G=a guanine nucleobase,
- T=a thymine nucleobase,
- k=a cEt modified sugar moiety,
- d=a 2'-β-D-deoxyribosyl sugar moiety,
- o=a phosphodiester linkage, and
- s=a phosphorothioate internucleoside linkage.

Embodiment 45. An oligomeric compound comprising a modified oligonucleotide according to the following chemical notation: (THA-GalNAc₃)o Gks $^m$Cks Aks $^m$Cds Ums Tds Tds Ads Tds Tds Gds Ads Gds Tks Tks mCk (SEQ ID NO: 5006), wherein: A=an adenine nucleobase, mC=a 5-methyl cytosine nucleobase, G=a guanine nucleobase, T=a thymine nucleobase, U=a uracil nucleobase, k=a cEt modified sugar moiety, d=a 2'-β-D-deoxyribosyl sugar moiety, o=a phosphodiester linkage, and s=a phosphorothioate internucleoside linkage.

Embodiment 46. An oligomeric duplex comprising the oligomeric compound of any of embodiments 1-36.

Embodiment 47. An antisense compound comprising or consisting of an oligomeric compound of any of embodiments 1-45 or an oligomeric duplex of embodiment 46.

Embodiment 48. A pharmaceutical composition comprising an oligomeric compound of any of embodiments 1-45, an oligomeric duplex of embodiment 46, or an antisense compound of embodiment 47; and a pharmaceutically acceptable carrier or diluent.

Embodiment 49. The pharmaceutical composition of embodiment 48, wherein the pharmaceutically acceptable diluent is phosphate buffered saline.

Embodiment 50. The pharmaceutical composition of embodiment 49, wherein the pharmaceutical composition consists essentially of the modified oligonucleotide and phosphate buffered saline.

Embodiment 50. A method comprising administering to a subject a pharmaceutical composition of any of embodiments 48-50.

Embodiment 51. A method of ameliorating or preventing a thromboembolic condition, comprising administering to a subject in need thereof a therapeutically effective amount of a pharmaceutical composition according to any of embodiments 48-50.

Embodiment 51. The method of embodiment 52, wherein the thromboembolic condition is selected from myocardial infarction (MI), stroke, limb ischemia and necrosis, venous thromboembolism (VTE), deep vein thrombosis (DVT), and pulmonary embolism (PE).

Embodiment 53. The method of any of embodiments 51-53, wherein at least one symptom of the thromboembolic condition is ameliorated.

Embodiment 54. The method of embodiment 54, wherein the symptom is pain, shortness of breath, heart burn, cold sweat, fatigue, lightheadedness, dizziness, swelling, cramping, and death.

Embodiment 55. The method of any one of embodiments 51-55, comprising identifying the subject as having the thromboembolic condition or as having a risk factor for having the thromboembolic condition.

Embodiment 56. The method of embodiment 56, wherein the risk factor is surgery, malignancy, pregnancy, aging, use of oral contraceptives, immobility, sepsis, a mechanical heart valve, valvular heart disease, atrial fibrillation, atherosclerosis, antiphospholipid syndrome, an inherited clotting disorder, or an acquired prothrombotic clotting disorder.

Embodiment 57. A method of ameliorating or preventing hereditary angioedema, comprising administering to a subject in need thereof a therapeutically effective amount of a pharmaceutical composition according to any of embodiments 48-50.

Embodiment 58. A chirally enriched population of oligomeric compounds of any of embodiments 1-45, wherein the population is enriched for oligomeric compounds comprising at least one particular phosphorothioate internucleoside linkage having a particular stereochemical configuration.

Embodiment 59. The chirally enriched population of embodiment 59, wherein the population is enriched for oligomeric compounds comprising at least one particular phosphorothioate internucleoside linkage having the (Sp) configuration.

Embodiment 60. The chirally enriched population of embodiment 59, wherein the population is enriched for oligomeric compounds comprising at least one particular phosphorothioate internucleoside linkage having the (Rp) configuration.

Embodiment 61. The chirally enriched population of embodiment 59, wherein the population is enriched for oligomeric compounds having a particular, independently selected stereochemical configuration at each phosphorothioate internucleoside linkage.

Embodiment 62. The chirally enriched population of embodiment 62, wherein the population is enriched for oligomeric compounds having the (Sp) configuration at each phosphorothioate internucleoside linkage.

Embodiment 63. The chirally enriched population of embodiment 62, wherein the population is enriched for oligomeric compounds having the (Rp) configuration at each phosphorothioate internucleoside linkage.

Embodiment 64. The chirally enriched population of embodiment 62, wherein the population is enriched for oligomeric compounds having the (Rp) configuration at one particular phosphorothioate internucleoside linkage and the (Sp) configuration at each of the remaining phosphorothioate internucleoside linkages.

Embodiment 65. The chirally enriched population of embodiment 59 or embodiment 62, wherein the population is enriched for oligomeric compounds having at least 3 contiguous phosphorothioate internucleoside linkages in the Sp, Sp, and Rp configurations, in the 5' to 3' direction.

Embodiment 66. A chirally enriched population of oligomeric compounds of any of embodiments 1-45, wherein all of the phosphorothioate internucleoside linkages of the oligomeric compounds are stereorandom.

I. Certain Oligonucleotides

In certain embodiments, provided herein are oligomeric compounds comprising oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage.

A. Certain Modified Nucleosides

Modified nucleosides comprise a modified sugar moiety or a modified nucleobase or both a modified sugar moiety and a modified nucleobase.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N($R_m$)-alkyl, O-alkenyl, S-alkenyl, N($R_m$)-alkenyl, O-alkynyl, S-alkynyl, N($R_m$)-alkynyl, O-alkylenyl-O-alkyl, alkynyl, alkaryl, aralkyl, O-alkaryl, O-aralkyl, O($CH_2$)$_2$S$CH_3$, O($CH_2$)$_2$ON($R_m$)($R_n$) or O$CH_2$C(=O)—N($R_m$)($R_n$), where each $R_m$ and $R_n$ is, independently, H, an amino protecting group, or substituted or unsubstituted $C_1$-$C_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro ($NO_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5-methyl (R or S), 5'-vinyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.

In certain embodiments, a 2'-substituted non-bicyclic modified nucleoside comprises a sugar moiety comprising a non-bridging 2'-substituent group selected from: F, $NH_2$, $N_3$, O$CF_3$, O$CH_3$, O($CH_2$)$_3$$NH_2$, $CH_2$CH=$CH_2$, O$CH_2$CH=$CH_2$, O$CH_2$$CH_2$O$CH_3$, O($CH_2$)$_2$S$CH_3$, O($CH_2$)$_2$ ON($R_m$)($R_n$), O($CH_2$)$_2$O($CH_2$)$_2$N($CH_3$)$_2$, and N-substituted acetamide (O$CH_2$C(=O)—N($R_m$)($R_n$)), where each $R_m$ and $R_n$ is, independently, H, an amino protecting group, or substituted or unsubstituted $C_1$-$C_{10}$ alkyl.

In certain embodiments, a 2'-substituted nucleoside non-bicyclic modified nucleoside comprises a sugar moiety comprising a non-bridging 2'-substituent group selected from: F, O$CF_3$, O$CH_3$, O$CH_2$$CH_2$O$CH_3$, O($CH_2$)$_2$S$CH_3$, O($CH_2$)$_2$ON($CH_3$)$_2$, O($CH_2$)$_2$O($CH_2$)$_2$N($CH_3$)$_2$, and O$CH_2$C(=O)—N(H)$CH_3$ ("NMA").

In certain embodiments, a 2'-substituted non-bicyclic modified nucleoside comprises a sugar moiety comprising a non-bridging 2'-substituent group selected from: F, O$CH_3$, and O$CH_2$$CH_2$O$CH_3$.

Certain modified sugar moieties comprise a substituent that bridges two atoms of the furanosyl ring to form a second ring, resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-$CH_2$-2', 4'-($CH_2$)$_2$-2', 4'-($CH_2$)$_3$-2', 4'-$CH_2$—O-2' ("LNA"), 4'-$CH_2$—S-2', 4'-($CH_2$)$_2$—O-2' ("ENA"), 4'-CH($CH_3$)—O-2' (referred to as "constrained ethyl" or "cEt"), 4'-$CH_2$—O—$CH_2$-2', 4'-$CH_2$—N(R)-2', 4'-CH($CH_2$O$CH_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C($CH_3$)($CH_3$)—O-2' and analogs thereof (see, e.g., Seth et al., U.S. Pat. No. 8,278,283), 4'-$CH_2$—N(O$CH_3$)-2' and analogs thereof (see, e.g., Prakash et al., U.S. Pat. No. 8,278,425), 4'-$CH_2$—O—N($CH_3$)-2' (see, e.g., Allerson et al., U.S. Pat. No. 7,696,345 and Allerson et al., U.S. Pat. No. 8,124,745), 4'-$CH_2$—C(H)($CH_3$)-2' (see, e.g., Zhou, et al., J. Org. Chem., 2009, 74, 118-134), 4'-$CH_2$—C(=$CH_2$)-2' and analogs thereof (see e.g., Seth et al., U.S. Pat. No. 8,278,426), 4'-C($R_a$$R_b$)—N(R)—O-2', 4'-C($R_a$$R_b$)—O—N(R)-2', 4'-$CH_2$—O—N(R)-2', and 4'-$CH_2$—N(R)—O- 2', wherein each R, $R_a$, and $R_b$ is, independently, H, a protecting group, or $C_1$-$C_{12}$ alkyl (see, e.g. Imanishi et al., U.S. Pat. No. 7,427,672).

In certain embodiments, such 4' to 2' bridges independently comprise from 1 to 4 linked groups independently selected from: —[C($R_a$)($R_b$)]$_n$—, —[C($R_a$)($R_b$)]$_n$—O—, —C($R_a$)=C($R_b$)—, —C($R_a$)=N—, —C(=N$R_a$)—, —C(=O)—, —C(=S)—, —O—, —Si($R_a$)$_2$—, —S(=O)$_x$—, and —N($R_a$)—;

wherein: x is 0, 1, or 2; n is 1, 2, 3, or 4; each $R_a$ and $R_b$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, heterocycle radical, substituted heterocycle radical, heteroaryl, substituted heteroaryl, $C_5$-$C_7$ alicyclic radical, substituted $C_5$-$C_7$ alicyclic radical, halogen, O$J_1$, N$J_1$$J_2$, S$J_1$, $N_3$, COO$J_1$, acyl (C(=O)—H), substituted acyl, CN, sulfonyl (S(=O)$_2$-$J_1$), or sulfoxyl (S(=O)-$J_1$); and each $J_1$ and $J_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl, or a protecting group.

Additional bicyclic sugar moieties are known in the art, see, for example: Freier et al., Nucleic Acids Research, 1997, 25(22), 4429-4443, Albaek et al., J. Org. Chem., 2006, 71, 7731-7740, Singh et al., Chem. Commun., 1998, 4, 455-456; Koshkin et al., Tetrahedron, 1998, 54, 3607-3630; Kumar et al., Bioorg. Med. Chem. Lett., 1998, 8, 2219-2222; Singh et al., J. Org. Chem., 1998, 63, 10035-10039; Srivastava et al., J. Am. Chem. Soc., 2007, 129, 8362-8379; Wengel et a., U.S. Pat. No. 7,053,207; Imanishi et al., U.S. Pat. No. 6,268,490; Imanishi et al. U.S. Pat. No. 6,770,748; Imanishi et al., U.S. RE44,779; Wengel et al., U.S. Pat. No. 6,794,499; Wengel et al., U.S. Pat. No. 6,670,461; Wengel et al., U.S. Pat. No. 7,034,133; Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; Ramasamy et al., U.S. Pat. No. 6,525,191; Torsten et al., WO 2004/106356; Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

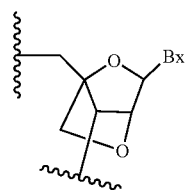

LNA (β-D-configuration)
bridge = 4'-CH$_2$—O-2'

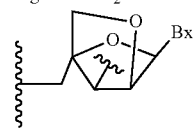

α-L-LNA (α-L-configuration)
bridge = 4'-CH$_2$—O-2'

α-L-methyleneoxy (4'-CH$_2$—O-2') or α-L-LNA bicyclic nucleosides have been incorporated into oligonucleotides that showed antisense activity (Frieden et al., *Nucleic Acids Research,* 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see, e.g., Leumann, C J. *Bioorg. & Med. Chem.* 2002, 10, 841-854), fluoro HNA:

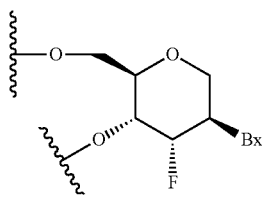

F-HNA ("F-HNA", see e.g. Swayze et al., U.S. Pat. No. 8,088,904; Swayze et al., U.S. Pat. No. 8,440,803; Swayze et al., U.S. Pat. No. 8,796,437; and Swayze et al., U.S. Pat. No. 9,005,906; F-HNA can also be referred to as a F-THP or 3'-fluoro tetrahydropyran), and nucleosides comprising additional modified THP compounds having the formula:

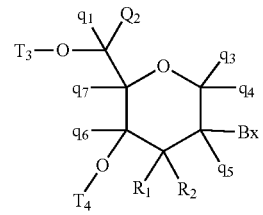

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

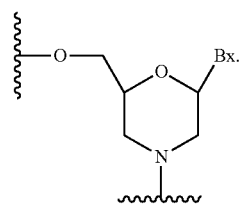

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., *Org. Biomol. Chem.,* 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides.

2. Certain Modified Nucleobases

In certain embodiments, modified oligonucleotides comprise one or more nucleosides comprising an unmodified nucleobase. In certain embodiments, modified oligonucleotides comprise one or more nucleosides comprising a modified nucleobase. In certain embodiments, modified oligonucleotides comprise one or more nucleosides that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and O-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (—C≡C—CH$_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in *The Concise Encyclopedia Of Polymer Science And Engineering*, Kroschwitz, J. I., Ed., John Wiley & Sons, 1990, 858-859; Englisch et al., *Angewandte Chemie*, International Edition, 1991, 30, 613; Sanghvi, Y. S., Chapter 15, *Antisense Research and Applications*, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., 6,166,199; and Matteucci et al., U.S. Pat. No. 6,005,096.

3. Certain Modified Internucleoside Linkages

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphodiesters, which contain a phosphodiester bond ("P(O$_2$)═O") (also referred to as unmodified or naturally occurring linkages), phosphotriesters, methylphosphonates, phosphoramidates, and phosphorothioates, and phosphorodithioates. Representative non-phosphorus containing internucleoside linking groups include but are not limited to methylenemethylimino (—CH$_2$—N(CH$_3$)—O—CH$_2$—), thiodiester, thionocarbamate (—O—C(═O)(NH)—S—); siloxane (—O—SiH$_2$—O—); and N,N'-dimethylhydrazine (—CH$_2$—N(CH$_3$)—N(CH$_3$)—). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

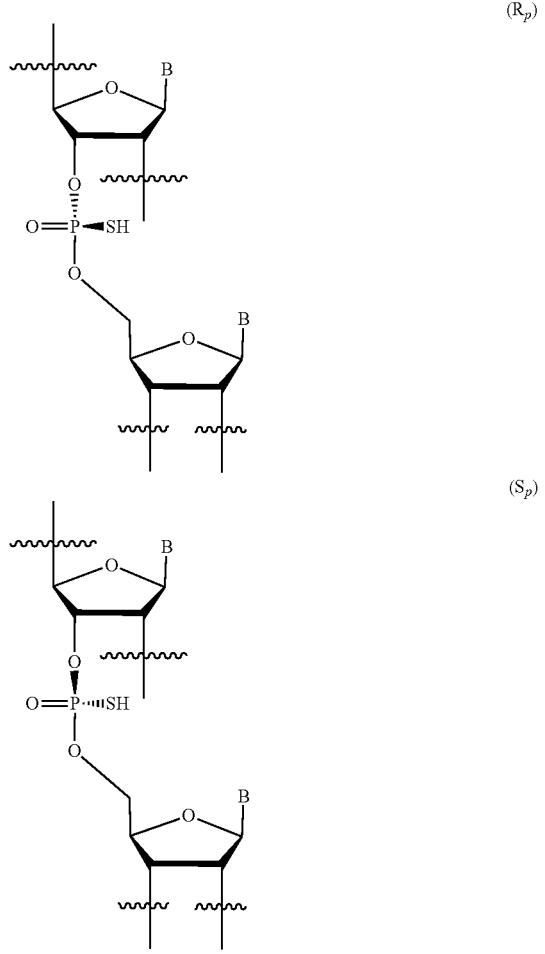

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'-$CH_2$—$N(CH_3)$—O-5'), amide-3 (3'-$CH_2$—C(=O)—N(H)-5'), amide-4 (3'-$CH_2$—N(H)—C(=O)-5'), formacetal (3'-O—$CH_2$—O-5'), methoxypropyl (MOP), and thioformacetal (3'-S—$CH_2$—O-5'). Further neutral internucleoside linkages include nonionic linkages comprising siloxane (dialkylsiloxane), carboxylate ester, carboxamide, sulfide, sulfonate ester and amides (See for example: *Carbohydrate Modifications in Antisense Research;* Y. S. Sanghvi and P. D. Cook, Eds., ACS Symposium Series 580; Chapters 3 and 4, 40-65). Further neutral internucleoside linkages include nonionic linkages comprising mixed N, O, S and $CH_2$ component parts.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or portion thereof in a defined pattern or sugar motif. In certain instances, such sugar motifs include but are not limited to any of the sugar modifications discussed herein.

In certain embodiments, modified oligonucleotides have a gapmer motif, which is defined by two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-6 nucleosides. In certain embodiments, each nucleoside of each wing of a gapmer comprises a modified sugar moiety. In certain embodiments, at least one nucleoside of each wing of a gapmer comprises a modified sugar moiety. In certain embodiments, at least two nucleosides of each wing of a gapmer comprises a modified sugar moiety. In certain embodiments, at least three nucleosides of each wing of a gapmer comprises a modified sugar moiety. In certain embodiments, at least four nucleosides of each wing of a gapmer comprises a modified sugar moiety. In certain embodiments, at least five nucleosides of each wing of a gapmer comprises a modified sugar moiety.

In certain embodiments, the gap of a gapmer comprises 7-12 nucleosides. In certain embodiments, each nucleoside of the gap of a gapmer comprises a 2'-β-D-deoxyribosyl sugar moiety. In certain embodiments, at least one nucleoside of the gap of a gapmer comprises a modified sugar moiety.

In certain embodiments, the gapmer is a deoxy gapmer. In certain embodiments, the nucleosides on the gap side of each wing/gap junction comprise 2'-β-D-deoxyribosyl sugar moieties and the nucleosides on the wing sides of each wing/gap junction comprise modified sugar moieties. In certain embodiments, each nucleoside of the gap comprises a 2'-β-D-deoxyribosyl sugar moiety. In certain embodiments, each nucleoside of each wing of a gapmer comprises a modified sugar moiety. In certain embodiments, exactly one nucleoside of the gap comprises a modified sugar moiety and each remaining nucleoside of the gap comprises a 2'-β-D-deoxyribosyl sugar moiety.

In certain embodiments, modified oligonucleotides comprise or consist of a portion having a fully modified sugar motif. In such embodiments, each nucleoside of the fully modified portion of the modified oligonucleotide comprises a modified sugar moiety. In certain embodiments, each nucleoside of the entire modified oligonucleotide comprises a modified sugar moiety. In certain embodiments, modified oligonucleotides comprise or consist of a portion having a fully modified sugar motif, wherein each nucleoside within the fully modified portion comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

Herein, the lengths (number of nucleosides) of the three regions of a gapmer may be provided using the notation [# of nucleosides in the 5'-wing]-[# of nucleosides in the gap]-[# of nucleosides in the 3'-wing]. Thus, a 3-10-3 gapmer consists of 3 linked nucleosides in each wing and 10 linked nucleosides in the gap. Where such nomenclature is followed by a specific modification, that modification is the modification in each sugar moiety of each wing and the gap nucleosides comprise 2'-β-D-deoxyribosyl sugar moieties. Thus, a 5-10-5 MOE gapmer consists of 5 linked 2'-MOE nucleosides in the 5'-wing, 10 linked 2'-β-D-deoxynucleosides in the gap, and 5 linked 2'-MOE nucleosides in the 3'-wing. A 3-10-3 cEt gapmer consists of 3 linked cEt nucleosides in the 5'-wing, 10 linked 2'-β-D-deoxynucleosides in the gap, and 3 linked cEt nucleosides in the 3'-wing. A 5-8-5 gapmer consists of 5 linked nucleosides comprising a modified sugar moiety in the 5'-wing, 8 linked 2'-β-D-deoxynucleosides in the gap, and 5 linked nucleosides comprising a modified sugar moiety in the 3'-wing. A 5-8-5 mixed gapmer has at least two different modified sugar moieties in the 5'- and/or the 3'-wing.

In certain embodiments, modified oligonucleotides are 5-10-5 MOE gapmers. In certain embodiments, modified oligonucleotides are 4-10-6 MOE gapmers. In certain embodiments, modified oligonucleotides are 6-10-4 MOE gapmers. In certain embodiments, modified oligonucleotides are 5-8-5 MOE gapmers. In certain embodiments, modified oligonucleotides are 6-8-4 MOE gapmers. In certain embodiments, modified oligonucleotides are 4-8-6 MOE gapmers. In certain embodiments, modified oligonucleotides are X-Y-Z MOE gapmers, wherein X and Z are independently selected from 1, 2, 3, 4, 5, or 6 and Y is 7, 8, 9, 10, or 11.

2. Certain Nucleobase Motifs

In certain embodiments, oligonucleotides comprise modified and/or unmodified nucleobases arranged along the oligonucleotide or portion thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methyl cytosines. In certain embodiments, all of the cytosine nucleobases are 5-methyl cytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-β-D-deoxyribosyl sugar moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or portion thereof in a defined pattern or motif. In certain embodiments, each internucleoside linking group is a phosphodiester internucleoside linkage ($P(O_2)$=O). In certain embodiments, each internucleoside linking group of a modified oligonucleotide is a phosphorothioate internucleoside linkage ($P(O_2)$=S). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate, a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

In certain embodiments, modified nucleotides have an internucleoside linkage motif of sooooosssssssssssooss, wherein each "s" represents a phosphorothioate internucleoside linkage and each "o" represents a phosphodiester internucleoside linkage. In certain embodiments, modified nucleotides have an internucleoside linkage motif of sooooosssssssssssoss, wherein each "s" represents a phosphorothioate internucleoside linkage and each "o" represents a phosphodiester internucleoside linkage. In certain embodiments, modified nucleotides have an internucleoside linkage motif of sooooosssssssssssoss, wherein each "s" represents a phosphorothioate internucleoside linkage and each "o" represents a phosphodiester internucleoside linkage. In certain embodiments, modified nucleotides have an internucleoside linkage motif of soooossssssssssooss, wherein each "s" represents a phosphorothioate internucleoside linkage and each "o" represents a phosphodiester internucleoside linkage. In certain embodiments, modified nucleotides have an internucleoside linkage motif of sooosssssssssssooss, wherein each "s" represents a phosphorothioate internucleoside linkage and each "o" represents a phosphodiester internucleoside linkage. In certain embodiments, modified nucleotides have an internucleoside linkage motif of soosssssssssooss, wherein each "s" represents a phosphorothioate internucleoside linkage and each "o" represents a phosphodiester internucleoside linkage.

C. Certain Lengths

It is possible to increase or decrease the length of an oligonucleotide without eliminating activity. For example, in Woolf et al. (Proc. Natl. Acad. Sci. USA 89:7305-7309, 1992), a series of oligonucleotides 13-25 nucleobases in length were tested for their ability to induce cleavage of a target RNA in an oocyte injection model. Oligonucleotides 25 nucleobases in length with 8 or 11 mismatch bases near the ends of the oligonucleotides were able to direct specific cleavage of the target RNA, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides.

D. Certain Modified Oligonucleotides

In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for R-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a portion of an oligonucleotide has a nucleobase sequence that is complementary to a second oligonucleotide or an identified reference nucleic acid, such as a target nucleic acid. In certain embodiments, the nucleobase sequence of a portion or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

II. Certain Oligomeric Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., *Bioorg. Med. Chem. Lett.*, 1994, 4, 1053-1060), a thioether, e.g., hexyl-S-tritylthiol (Manoharan et al., *Ann. N.Y. Acad. Sci.*, 1992, 660, 306-309; Manoharan et al., *Bioorg. Med. Chem. Lett.*, 1993, 3, 2765-2770), a thiocholesterol (Oberhauser et al., *Nucl. Acids Res.*, 1992, 20, 533-538), an aliphatic chain, e.g., do-decan-diol or undecyl residues (Saison-Behmoaras et al., *EMBO J.*, 1991, 10, 1111-1118; Kabanov et al., *FEBS Lett.*, 1990, 259, 327-330; Svinarchuk et al., *Biochimie*, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.*, 1995, 36, 3651-3654; Shea et al., *Nucl. Acids Res.*, 1990, 18, 3777-3783), a polyamine or a polyethylene glycol chain (Manoharan et al., *Nucleosides & Nucleotides*, 1995, 14, 969-973), or adamantane acetic acid a palmityl moiety (Mishra et al., *Biochim. Biophys. Acta*, 1995, 1264, 229-237), an octadecylamine or hexylamino-carbonyl-oxycholesterol moiety (Crooke et al., *J. Pharmacol. Exp. Ther.*, 1996, 277, 923-937), a tocopherol group (Nishina et al., *Molecular Therapy Nucleic Acids*, 2015, 4, e220; and Nishina et al., *Molecular Therapy*, 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methyl cytosine, 4-N-benzoyl-5-methyl cytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among an amide, an ester, an ether, one or both esters of a phosphodiester, a phosphate ester, a carbamate, and a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate or phosphodiester linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2'-deoxynucleoside that is attached to either the 3' or 5'-terminal nucleoside of an oligonucleotide by a phosphodiester internucleoside linkage and covalently attached to the remainder of the conjugate linker or conjugate moiety by a phosphate or phosphorothioate linkage. In certain such embodiments, the cleavable moiety is 2'-deoxyadenosine.

3. Cell-Targeting Moieties

In certain embodiments, a conjugate group comprises a cell-targeting moiety. In certain embodiments, a conjugate group has the general formula:

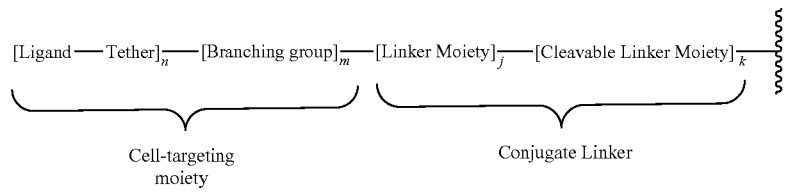

wherein n is from 1 to about 3, m is 0 when n is 1, m is 1 when n is 2 or greater, j is 1 or 0, and k is 1 or 0.

In certain embodiments, n is 1, j is 1 and k is 0. In certain embodiments, n is 1, j is 0 and k is 1. In certain embodiments, n is 1, j is 1 and k is 1. In certain embodiments, n is 2, j is 1 and k is 0. In certain embodiments, n is 2, j is 0 and k is 1. In certain embodiments, n is 2, j is 1 and k is 1. In certain embodiments, n is 3, j is 1 and k is 0. In certain embodiments, n is 3, j is 0 and k is 1. In certain embodiments, n is 3, j is 1 and k is 1.

In certain embodiments, conjugate groups comprise cell-targeting moieties that have at least one tethered ligand. In certain embodiments, cell-targeting moieties comprise two tethered ligands covalently attached to a branching group. In certain embodiments, cell-targeting moieties comprise three tethered ligands covalently attached to a branching group.

In certain embodiments, the cell-targeting moiety comprises a branching group comprising one or more groups selected from alkyl, amino, oxo, amide, disulfide, polyethylene glycol, ether, thioether and hydroxylamino groups. In certain embodiments, the branching group comprises a branched aliphatic group comprising groups selected from alkyl, amino, oxo, amide, disulfide, polyethylene glycol, ether, thioether and hydroxylamino groups. In certain such embodiments, the branched aliphatic group comprises groups selected from alkyl, amino, oxo, amide and ether groups. In certain such embodiments, the branched aliphatic group comprises groups selected from alkyl, amino and ether groups. In certain such embodiments, the branched aliphatic group comprises groups selected from alkyl and ether groups. In certain embodiments, the branching group comprises a mono or polycyclic ring system.

In certain embodiments, each tether of a cell-targeting moiety comprises one or more groups selected from alkyl, substituted alkyl, ether, thioether, disulfide, amino, oxo, amide, phosphodiester, and polyethylene glycol, in any combination. In certain embodiments, each tether is a linear aliphatic group comprising one or more groups selected from alkyl, ether, thioether, disulfide, amino, oxo, amide, and polyethylene glycol, in any combination. In certain embodiments, each tether is a linear aliphatic group comprising one or more groups selected from alkyl, phosphodiester, ether, amino, oxo, and amide, in any combination. In certain embodiments, each tether is a linear aliphatic group comprising one or more groups selected from alkyl, ether, amino, oxo, and amid, in any combination. In certain embodiments, each tether is a linear aliphatic group comprising one or more groups selected from alkyl, amino, and oxo, in any combination. In certain embodiments, each tether is a linear aliphatic group comprising one or more groups selected from alkyl and oxo, in any combination. In certain embodiments, each tether is a linear aliphatic group comprising one or more groups selected from alkyl and phosphodiester, in any combination. In certain embodiments, each tether comprises at least one phosphorus linking group or neutral linking group. In certain embodiments, each tether comprises a chain from about 6 to about 20 atoms in length. In certain embodiments, each tether comprises a chain from about 10 to about 18 atoms in length. In certain embodiments, each tether comprises about 10 atoms in chain length.

In certain embodiments, each ligand of a cell-targeting moiety has an affinity for at least one type of receptor on a target cell. In certain embodiments, each ligand has an affinity for at least one type of receptor on the surface of a mammalian liver cell. In certain embodiments, each ligand has an affinity for the hepatic asialoglycoprotein receptor (ASGP-R). In certain embodiments, each ligand is a carbohydrate. In certain embodiments, each ligand is, independently selected from galactose, N-acetyl galactosamine (GalNAc), mannose, glucose, glucosamine and fucose. In certain embodiments, each ligand is N-acetyl galactosamine (GalNAc). In certain embodiments, the cell-targeting moiety comprises 3 GalNAc ligands. In certain embodiments, the cell-targeting moiety comprises 2 GalNAc ligands. In certain embodiments, the cell-targeting moiety comprises 1 GalNAc ligand.

In certain embodiments, each ligand of a cell-targeting moiety is a carbohydrate, carbohydrate derivative, modified carbohydrate, polysaccharide, modified polysaccharide, or polysaccharide derivative. In certain such embodiments, the conjugate group comprises a carbohydrate cluster (see, e.g., Maier et al., "Synthesis of Antisense Oligonucleotides Conjugated to a Multivalent Carbohydrate Cluster for Cellular Targeting," *Bioconjugate Chemistry*, 2003, 14, 18-29, or Rensen et al., "Design and Synthesis of Novel N-Acetylgalactosamine-Terminated Glycolipids for Targeting of Lipoproteins to the Hepatic Asiaglycoprotein Receptor," *J. Med. Chem.* 2004, 47, 5798-5808, which are incorporated herein by reference in their entirety). In certain such embodiments, each ligand is an amino sugar or a thio sugar. For example, amino sugars may be selected from any number of compounds known in the art, such as sialic acid, α-D-galactosamine, β-muramic acid, 2-deoxy-2-methylamino-L-glucopyranose, 4,6-dideoxy-4-formamido-2,3-di-O-methyl-D-mannopyranose, 2-deoxy-2-sulfoamino-D-glucopyranose and N-sulfo-D-glucosamine, and N-glycoloyl-α-neuraminic acid. For example, thio sugars may be selected from 5-Thio-β-D-glucopyranose, methyl 2,3,4-tri-O-acetyl-1-thio-6-O-trityl-α-D-glucopyranoside, 4-thio-β-D-galactopyranose, and ethyl 3,4,6,7-tetra-O-acetyl-2-deoxy-1,5-dithio-α-D-gluco-heptopyranoside.

In certain embodiments, conjugate groups comprise a cell-targeting moiety having the formula:

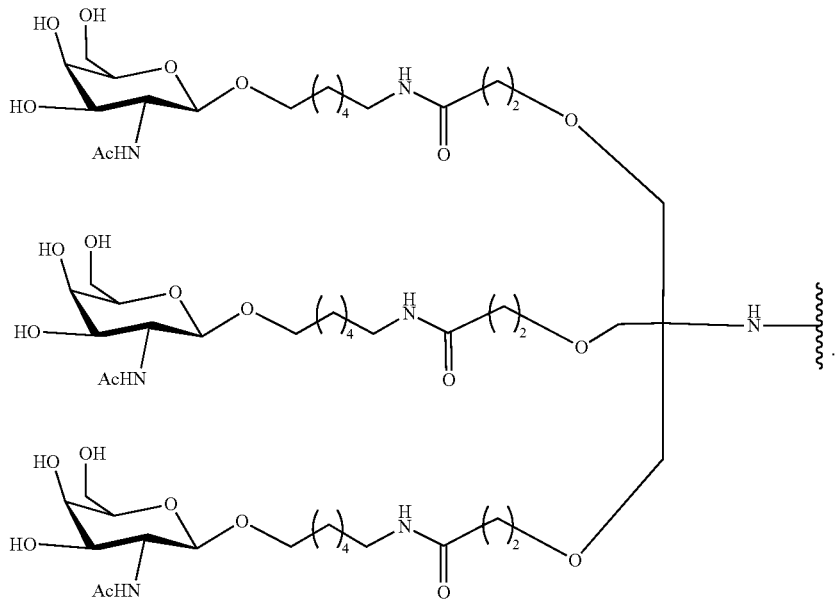

In certain embodiments, conjugate groups comprise a cell-targeting moiety having the formula:

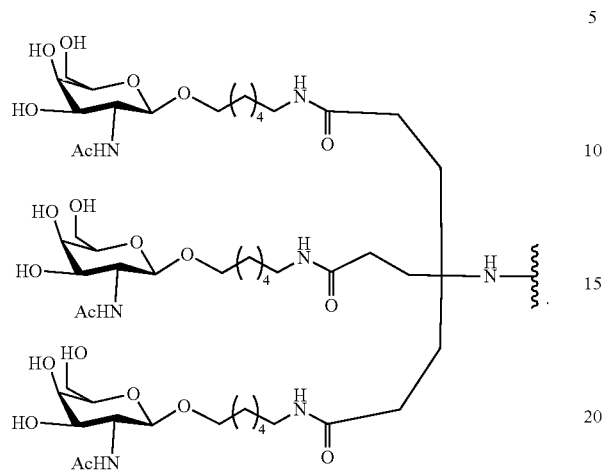

In certain embodiments, conjugate groups comprise a cell-targeting moiety having the formula:

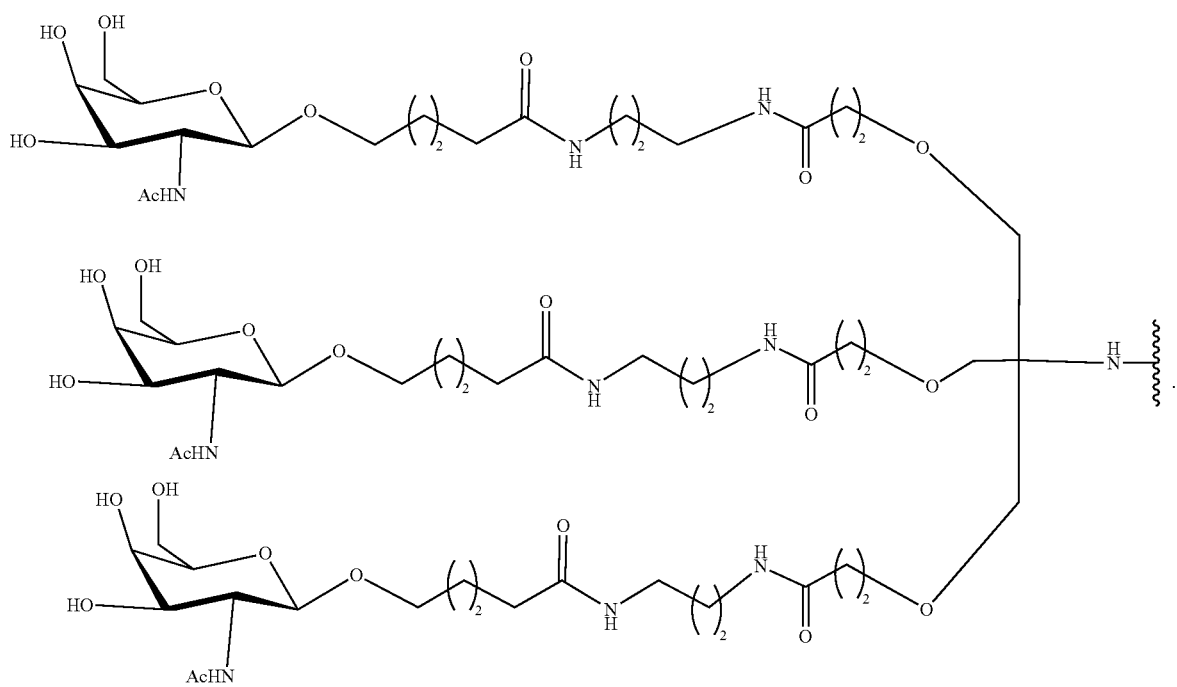

In certain embodiments, compounds described herein comprise a conjugate group described herein as "THA-GalNAac₃". THA-GalNAc₃ is shown below without the optional cleavable moiety at the end of the linker region:

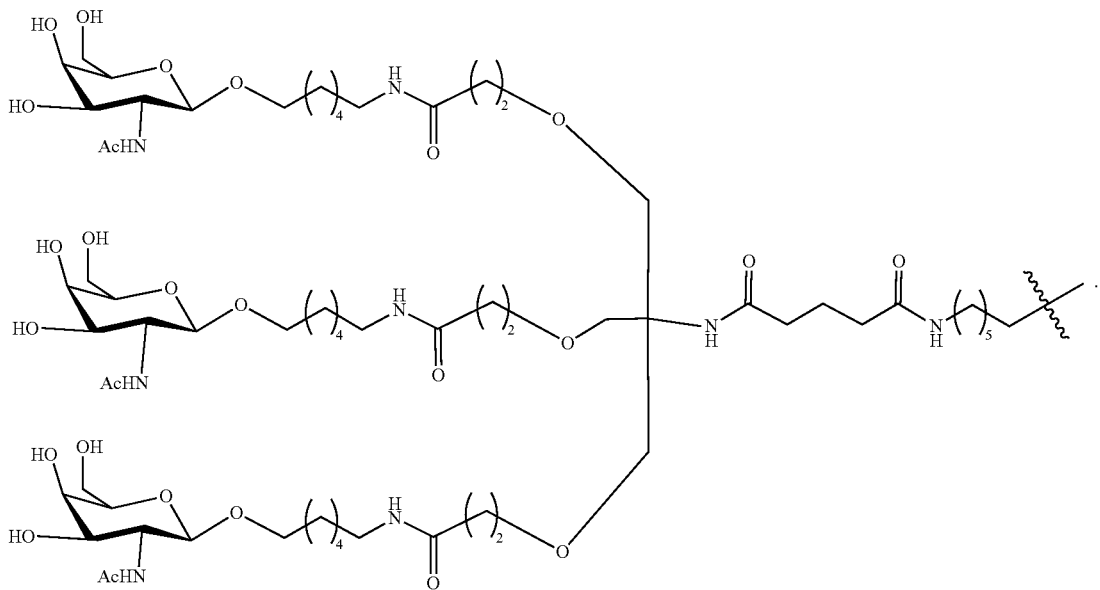

In certain embodiments, compounds described herein comprise THA-GalNAc$_3$-phosphate, also represented as (THA-GalNAc$_3$)o, having the formula:

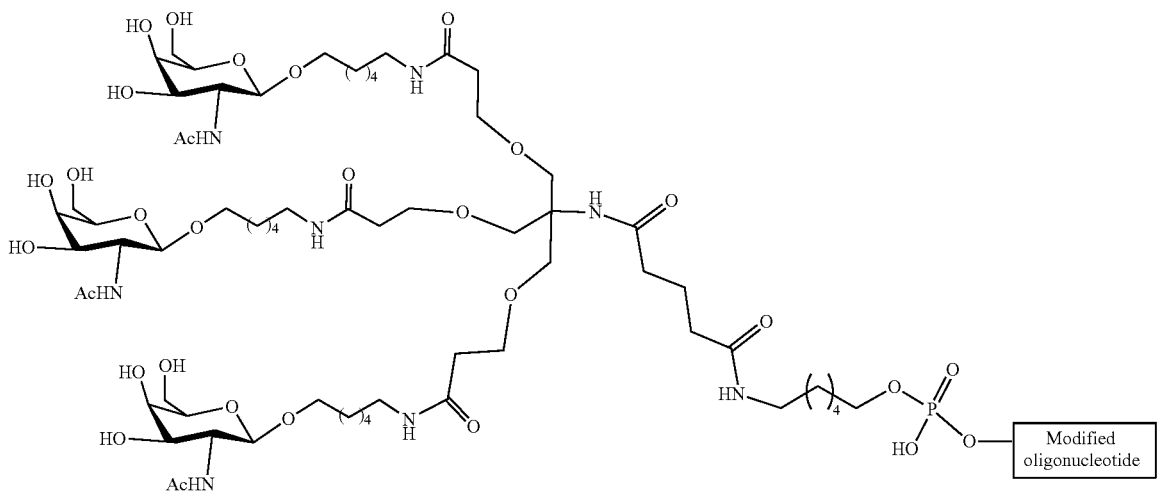

wherein modified oligonucleotide represents a modified oligonucleotide.

In certain embodiments, compounds described herein comprise a 3'-THA-C6-GalNAc hydroxyproline phosphate, ("HPPO-GalNAc"). 3'-HPPO-GalNAc is represented by the structure below wherein the phosphate group is attached to the 3'-oxygen atom of the 3' nucleoside:

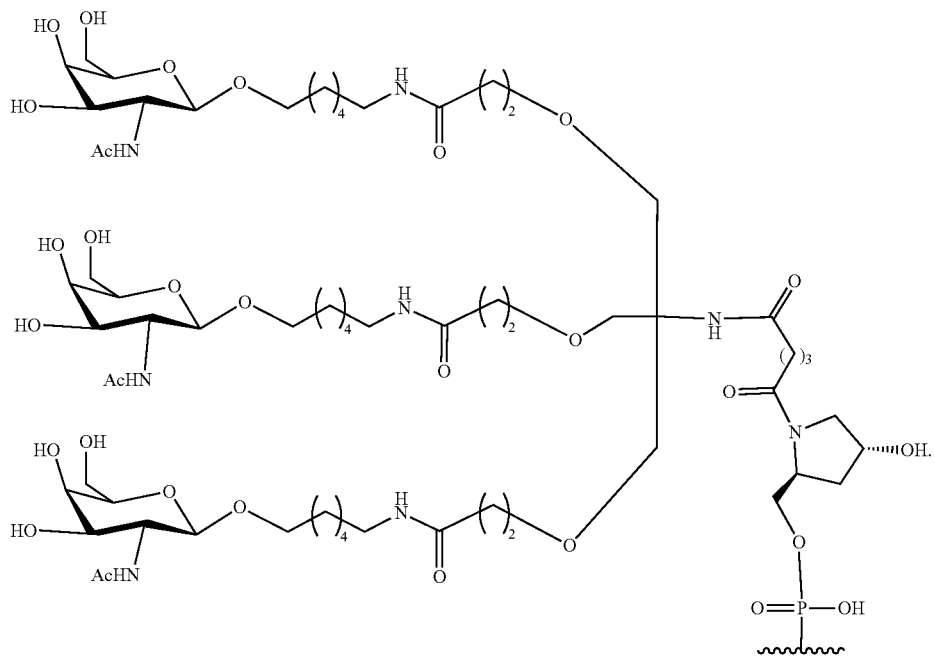

Representative publications that teach the preparation of certain of the above noted conjugate groups and compounds comprising conjugate groups, tethers, conjugate linkers, branching groups, ligands, cleavable moieties as well as other modifications include without limitation, U.S. Pat. Nos. 5,994,517, 6,300,319, 6,660,720, 6,906,182, 7,262,177, 7,491,805, 8,106,022, 7,723,509, 9,127,276, US 2006/0148740, US 2011/0123520, WO 2013/033230 and WO 2012/037254, Biessen et al., *J. Med. Chem.* 1995, 38, 1846-1852, Lee et al., *Bioorganic & Medicinal Chemistry* 2011, 19, 2494-2500, Rensen et al., *J. Biol. Chem.* 2001, 276, 37577-37584, Rensen et al., *J. Med. Chem.* 2004, 47, 5798-5808, Sliedregt et al., *J. Med. Chem.* 1999, 42, 609-618, and Valentijn et al., *Tetrahedron*, 1997, 53, 759-770, each of which is incorporated by reference herein in its entirety.

In certain embodiments, compounds described herein comprise modified oligonucleotides comprising a gapmer or fully modified motif and a conjugate group comprising at least one, two, or three GalNAc ligands. In certain embodiments compounds described herein comprise a conjugate group found in any of the following references: Lee, *Carbohydr Res*, 1978, 67, 509-514; Connolly et al., *J Biol Chem*, 1982, 257, 939-945; Pavia et al., *Int J Pep Protein Res*, 1983, 22, 539-548; Lee et al., *Biochem*, 1984, 23, 4255-4261; Lee et al., *Glycoconjugate J*, 1987, 4, 317-328; Toyokuni et al., *Tetrahedron Lett*, 1990, 31, 2673-2676; Biessen et al., *J Med Chem*, 1995, 38, 1538-1546; Valentijn et al., *Tetrahedron*, 1997, 53, 759-770; Kim et al., *Tetrahedron Lett*, 1997, 38, 3487-3490; Lee et al., *Bioconjug Chem*, 1997, 8, 762-765; Kato et al., *Glycobiol*, 2001, 11, 821-829; Rensen et al., *J Biol Chem*, 2001, 276, 37577-37584; Lee et al., *Methods Enzymol*, 2003, 362, 38-43; Westerlind et al., *Glycoconj J*, 2004, 21, 227-241; Lee et al., *Bioorg Med Chem Lett*, 2006, 16(19), 5132-5135; Maierhofer et al., *Bioorg Med Chem*, 2007, 15, 7661-7676; Khorev et al., *Bioorg Med Chem*, 2008, 16, 5216-5231; Lee et al., *Bioorg Med Chem*, 2011, 19, 2494-2500; Kornilova et al., Analyt Biochem, 2012, 425, 43-46; Pujol et al., *Angew Chemie Int Ed Engl*, 2012, 51, 7445-7448; Biessen et al., *J Med Chem*, 1995, 38, 1846-1852; Sliedregt et al., *J Med Chem*, 1999, 42, 609-618; Rensen et al., *J Med Chem*, 2004, 47, 5798-5808; Rensen et al., *Arterioscler Thromb Vasc Biol*, 2006, 26, 169-175; van Rossenberg et al., *Gene Ther,* 2004, 11, 457-464; Sato et al., *J Am Chem Soc*, 2004, 126, 14013-14022; Lee et al., *J Org Chem*, 2012, 77, 7564-7571; Biessen et al., *FASEB J*, 2000, 14, 1784-1792; Rajur et al., *Bioconjug Chem*, 1997, 8, 935-940; Duff et al., *Methods Enzymol*, 2000, 313, 297-321; Maier et al., *Bioconjug Chem*, 2003, 14, 18-29; Jayaprakash et al., *Org Lett*, 2010, 12, 5410-5413; Manoharan, *Antisense Nucleic Acid Drug Dev,* 2002, 12, 103-128; Merwin et al., *Bioconjug Chem*, 1994, 5, 612-620; Tomiya et al., *Bioorg Med Chem*, 2013, 21, 5275-5281; International applications WO1998/013381; WO2011/038356; WO1997/046098; WO2008/098788; WO2004/101619; WO2012/037254; WO2011/120053; WO2011/100131; WO2011/163121; WO2012/177947; WO2013/033230; WO2013/075035; WO2012/083185; WO2012/083046; WO2009/082607; WO2009/134487; WO2010/144740; WO2010/148013; WO1997/020563; WO2010/088537; WO2002/043771; WO2010/129709; WO2012/068187; WO2009/126933; WO2004/024757; WO2010/054406; WO2012/089352; WO2012/089602; WO2013/166121; WO2013/165816; U.S. Pat. Nos. 4,751,219; 8,552,163; 6,908,903; 7,262,177; 5,994,517; 6,300,319; 8,106,022; 7,491,805; 7,491,805; 7,582,744; 8,137,695; 6,383,812; 6,525,031; 6,660,720; 7,723,509; 8,541,548; 8,344,125; 8,313,772; 8,349,308; 8,450,467; 8,501,930; 8,158,601; 7,262,177; 6,906,182; 6,620,916; 8,435,491; 8,404,862; 7,851,615; Published U.S. Patent Application Publications US2011/0097264; US2011/0097265; US2013/0004427; US2005/0164235; US2006/0148740; US2008/0281044; US2010/0240730; US2003/0119724; US2006/0183886; US2008/0206869; US2011/0269814; US2009/0286973; US2011/0207799; US2012/0136042; US2012/0165393; US2008/0281041; US2009/0203135; US2012/0035115; US2012/0095075; US2012/0101148; US2012/0128760; US2012/0157509; US2012/0230938; US2013/0109817; US2013/0121954; US2013/

0178512; US2013/0236968; US2011/0123520; US2003/0077829; US2008/0108801; and US2009/0203132; each of which is incorporated by reference in its entirety.

B. Certain Terminal Groups

In certain embodiments, oligomeric compounds comprise one or more terminal groups. In certain such embodiments, oligomeric compounds comprise a stabilized 5'-phosphate. Stabilized 5'-phosphates include, but are not limited to 5'-phosphinates, including, but not limited to 5'-vinylphosphonates. In certain embodiments, terminal groups comprise one or more abasic nucleosides and/or inverted nucleosides. In certain embodiments, terminal groups comprise one or more 2'-linked nucleosides. In certain such embodiments, the 2'-linked nucleoside is an abasic nucleoside.

III. Oligomeric Duplexes

In certain embodiments, oligomeric compounds described herein comprise an oligonucleotide, having a nucleobase sequence complementary to that of a target nucleic acid. In certain embodiments, an oligomeric compound is paired with a second oligomeric compound to form an oligomeric duplex. Such oligomeric duplexes comprise a first oligomeric compound having a portion complementary to a target nucleic acid and a second oligomeric compound having a portion complementary to the first oligomeric compound. In certain embodiments, the first oligomeric compound of an oligomeric duplex comprises or consists of (1) a modified or unmodified oligonucleotide and optionally a conjugate group and (2) a second modified or unmodified oligonucleotide and optionally a conjugate group. Either or both oligomeric compounds of an oligomeric duplex may comprise a conjugate group. The oligonucleotides of each oligomeric compound of an oligomeric duplex may include non-complementary overhanging nucleosides.

IV. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce or inhibit the amount or activity of a target nucleic acid by 25% or more in the standard cell assay. In certain embodiments, antisense compounds selectively affect one or more target nucleic acid. Such antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein and/or a phenotypic change in a cell or subject.

V. Certain Target Nucleic Acids

In certain embodiments, oligomeric compounds comprise or consist of an oligonucleotide comprising a portion that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature mRNA, and a pre-mRNA, including intronic, exonic and untranslated regions. In certain embodiments, the target RNA is an antisense transcript. In certain embodiments, the target RNA is a mature mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron. In certain embodiments, the target nucleic acid is the RNA transcriptional product of a retrogene. In certain embodiments, the target nucleic acid is a non-coding RNA. In certain such embodiments, the target non-coding RNA is selected from: a long non-coding RNA, a short non-coding RNA, an intronic RNA molecule.

A. Complementarity/Mismatches to the Target Nucleic Acid

It is possible to introduce mismatch bases without eliminating activity. For example, Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and 28 and 42 nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a portion that is 100% or fully complementary to a target nucleic acid. In certain embodiments, the portion of full complementarity is 6, 7, 8, 9, 10, 11, 12, 13, 14, 15, 16, 17, 18, 19, 20, 21, 22, 23, or 24 nucleobases in length.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved. In certain embodiments, the mismatch is specifically positioned within an oligonucleotide having a gapmer motif. In certain embodiments, the mismatch is at position 1, 2, 3, 4, 5, 6, 7, or 8 from the 5'-end of the gap region. In certain embodiments, the mismatch is at position 9, 8, 7, 6, 5, 4, 3, 2, 1 from the 3'-end of the gap region. In certain embodiments, the mismatch is at position 1, 2, 3, or 4 from the 5'-end of the wing region. In certain embodiments, the mismatch is at position 4, 3, 2, or 1 from the 3'-end of the wing region.

B. FXII

In certain embodiments, oligomeric compounds comprise or consist of an oligonucleotide, or portion thereof, that is complementary to a target nucleic acid, wherein the target nucleic acid is a FXII nucleic acid. In certain embodiments, the FXII nucleic acid has the human FXII mRNA sequence designated herein as SEQ ID NO: 1 (ENSEMBL ID ENST00000253496.3 from ENSEMBL version 99: January 2020). In certain embodiments, the FXII nucleic acid has the human F12 genomic sequence, designated herein as SEQ ID NO: 2 (ENSEMBL ID ENSG00000131187.9 from ENSEML version 99: January 2020, human reference assembly version GRCh38.p13 located on the reverse strand of chromosome 5 from positions 177,402,140 to 177,409,576). In certain embodiments, the FXII nucleic acid has the human F12 genomic sequence, designated herein as SEQ ID NO. 3 (the complement of GENBANK Accession No. NC_000005.10 truncated from truncated from nucleotides 177399001 to 177413000). In certain embodiments, the FXII nucleic acid has the human FXII mRNA sequence designated herein as SEQ ID NO: 4 (GENBANK Accession No. NM_000505.3).

In certain embodiments, an oligomeric compound complementary to any one of SEQ ID NOS: 1-4 is capable of reducing FXII RNA in a cell. In certain embodiments, an oligomeric compound complementary to any one of SEQ ID NOS: 1-4 is capable of reducing FXII protein in a cell. In certain embodiments, the cell is in vitro. In certain embodiments, the cell is in a subject. In certain embodiments, an oligomeric compound complementary to any one of SEQ ID NOS: 1-4 is capable of ameliorating one or more symptoms of a thromboembolic condition when administered to a subject. In certain embodiments, the thromboembolic condition is deep vein thrombosis, venous thrombosis, arterial thrombosis, pulmonary embolism, myocardial infarction, or stroke. In certain embodiments, the symptoms are selected from pain, shortness of breath, heart burn, cold sweat, fatigue, lightheadedness, dizziness, swelling, cramping, and death.

In certain embodiments, an oligomeric compound complementary to any one of SEQ ID NOS: 1-4 is capable of reducing the detectable amount of FXII RNA in vitro by at least 10%, at least 20%, at least 30%, at least 40%, at least 50%, at least 60%, at least 70%, at least 80%, or at least 90%. In certain embodiments, an oligomeric compound complementary to any one of SEQ ID NOS: 1-4 is capable of reducing the detectable amount of FXII protein in vitro by at least 10%, at least 20%, at least 30%, at least 40%, at least 50%, at least 60%, at least 70%, at least 80%, or at least 90%. In certain embodiments, an oligomeric compound complementary to any one of SEQ ID NOS: 1-4 is capable of reducing the detectable amount of FXII RNA in a biological sample of a subject by at least 10%, at least 20%, at least 30%, at least 40%, at least 50%, at least 60%, at least 70%, at least 80%, or at least 90%. In certain embodiments, an oligomeric compound complementary to any one of SEQ ID NOS: 1-4 is capable of reducing the detectable amount of FXII protein in a biological sample of a subject by at least 10%, at least 20%, at least 30%, at least 40%, at least 50%, at least 60%, at least 70%, at least 80%, or at least 90%. In certain embodiments, the biological sample comprises blood, plasma/serum, or a cell of the subject.

VI. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS. In certain embodiments, a pharmaceutical composition comprises or consists of one or more oligomeric compound and artificial cerebrospinal fluid. In certain embodiments, the artificial cerebrospinal fluid is pharmaceutical grade.

In certain embodiments, a pharmaceutical composition comprises a modified oligonucleotide and artificial cerebrospinal fluid. In certain embodiments, a pharmaceutical composition consists of a modified oligonucleotide and artificial cerebrospinal fluid. In certain embodiments, a pharmaceutical composition consists essentially of a modified oligonucleotide and artificial cerebrospinal fluid. In certain embodiments, the artificial cerebrospinal fluid is pharmaceutical grade.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to a subject, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents of the present invention to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal (IT), intracerebroventricular (ICV), etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes.

Under certain conditions, certain compounds disclosed herein act as acids. Although such compounds may be drawn or described in protonated (free acid) form, or ionized and in association with a cation (salt) form, aqueous solutions of such compounds exist in equilibrium among such forms. For example, a phosphate linkage of an oligonucleotide in aqueous solution exists in equilibrium among free acid, anion and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. The term "oligonucleotide" is intended to include all such forms. Drawn structures necessarily depict a single form. Nevertheless, unless otherwise indicated, such drawings are likewise intended to include corresponding forms. Herein, a structure depicting the free acid of a compound followed by the term "or a salt thereof" expressly includes all such forms that may be fully or partially protonated/de-protonated/in association with a cation. In certain instances, one or more specific cation is identified.

In certain embodiments, modified oligonucleotides or oligomeric compounds are in aqueous solution with sodium. In certain embodiments, modified oligonucleotides or oligomeric compounds are in aqueous solution with potassium. In certain embodiments, modified oligonucleotides or oligomeric compounds are in PBS. In certain embodiments, modified oligonucleotides or oligomeric compounds are in water. In certain such embodiments, the pH of the solution is adjusted with NaOH and/or HCl to achieve a desired pH.

VII. Certain Compositions

1. Compound No. 1194357

In certain embodiments, Compound No. 1194357 is characterized as an oligomeric compound consisting of a conjugate group and a modified oligonucleotide, wherein the conjugate group is a THA-GalNAc$_3$ that is directly attached to the 5' end of the modified oligonucleotide through a phosphodiester linkage, (THA-GalNAc$_3$)o; wherein (THA-GalNAc$_3$)o is represented by the following structure:

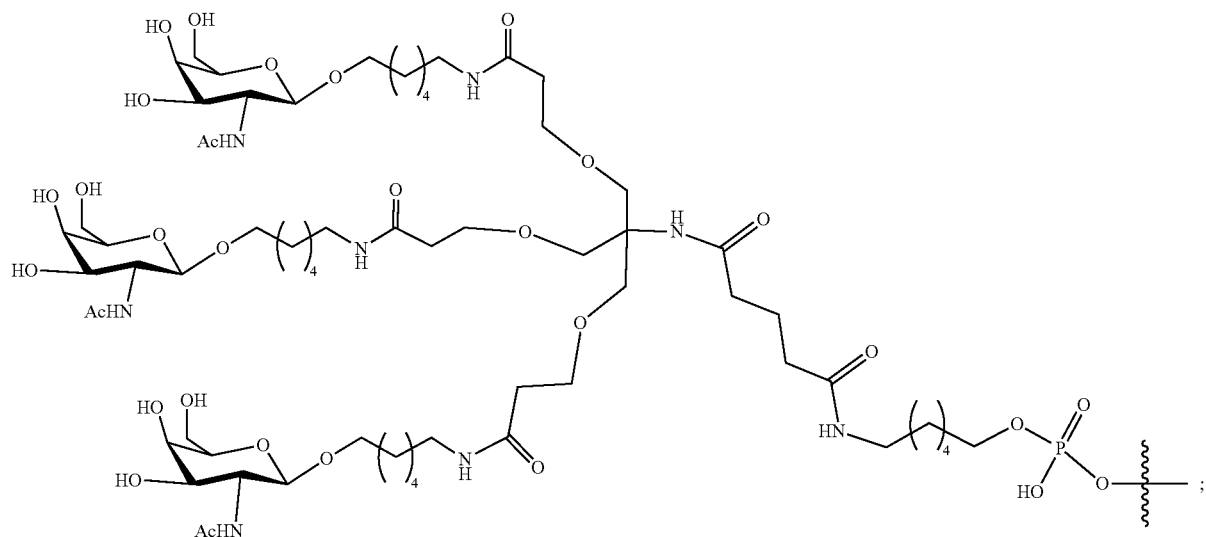

wherein the modified oligonucleotide is a 3-10-3 cEt gapmer, having a sequence of (from 5' to 3') GCGGAATCAC-CAAGGA (incorporated herein as SEQ ID NO: 3379); wherein each of nucleosides 1-3 and 14-16 (from 5' to 3') comprise a cEt modified sugar moiety and each of nucleosides 4-13 are 2'-β-D-deoxynucleosides; wherein each internucleoside linkage is a phosphorothioate internucleoside linkage; and wherein each cytosine is a 5-methyl cytosine.

In certain embodiments, Compound No. 1194357 is represented by the following chemical notation: (THA-GalNAc₃)o Gks $^m$Cks Gks Gds Ads Ads Tds $^m$Cds Ads $^m$Cds $^m$Cds Ads Ads Gks Gks Ak, wherein:
  A=an adenine nucleobase,
  $^m$C=a 5-methyl cytosine nucleobase,
  G=a guanine nucleobase,
  T=a thymine nucleobase,
  k=a cEt modified sugar moiety,
  d=a 2'-β-D-deoxyribosyl sugar moiety, and
  s=a phosphorothioate internucleoside linkage.

In certain embodiments, provided is an oligomeric compound comprising a modified oligonucleotide and a conjugate group according to the following chemical notation: (THA-GalNAc₃)o Gks $^m$Cks Gks Gds Ads Ads Tds $^m$Cds Ads $^m$Cds $^m$Cds Ads Ads Gks Gks Ak, wherein:
  A=an adenine nucleobase,
  $^m$C=a 5-methyl cytosine nucleobase,
  G=a guanine nucleobase,
  T=a thymine nucleobase,
  k=a cEt modified sugar moiety,
  d=a 2'-β-D-deoxyribosyl sugar moiety, and
  s=a phosphorothioate internucleoside linkage;
and wherein (THA-GalNAc₃)o=

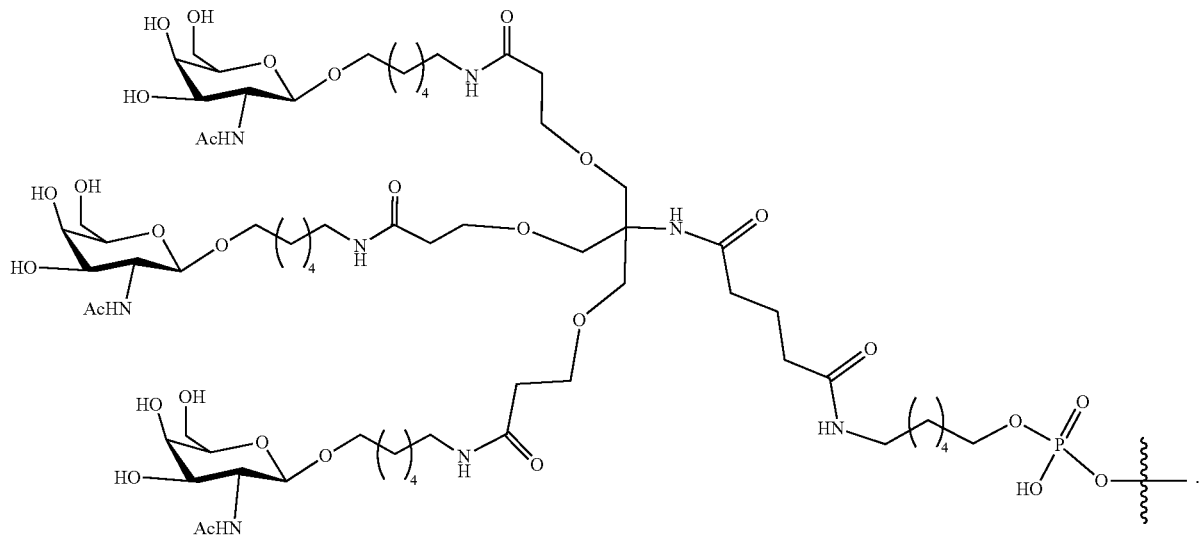

In certain embodiments, Compound No. 1194357 is represented by the following chemical structure:
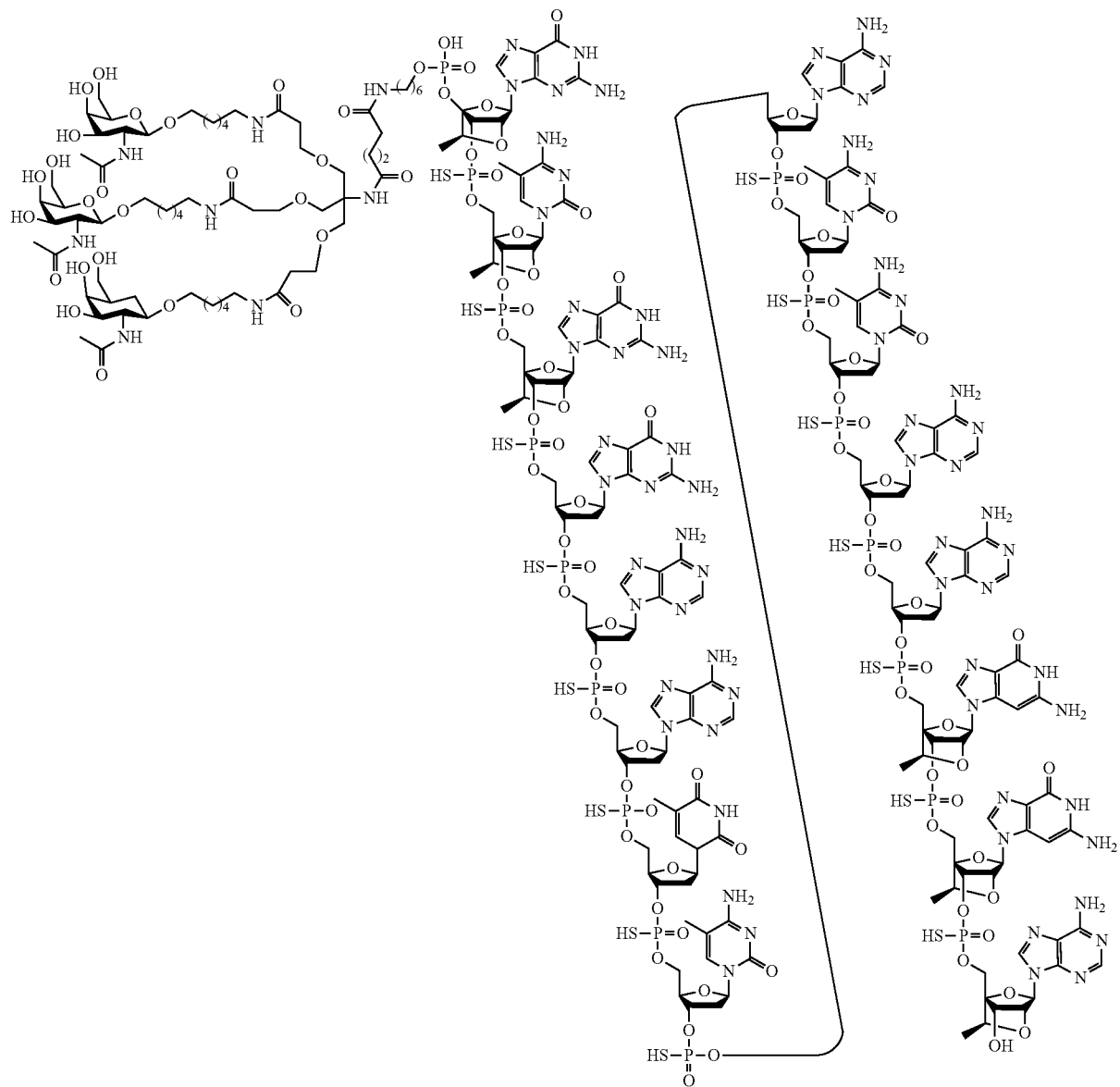
(SEQ ID NO: 3379). Structure 1. Compound No. 1194357
In certain embodiments, the sodium salt of Compound No. 1194357 is represented by the following chemical structure:

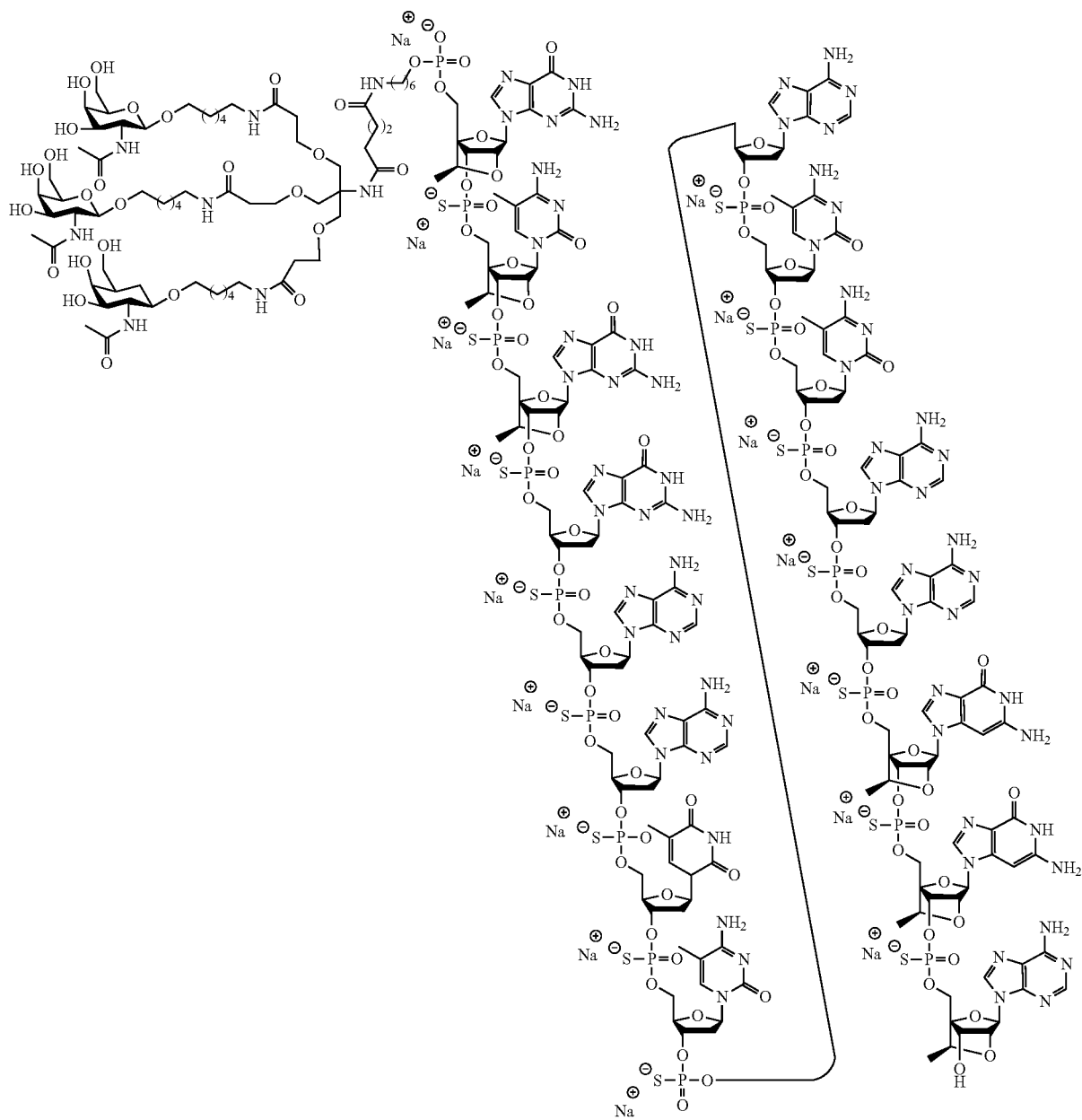

(SEQ ID NO: 3379). Structure 2. The sodium salt of Compound No. 1194357

2. Compound No. 1270705

In certain embodiments, Compound No. 1270705 is characterized as an oligomeric compound consisting of a conjugate group and a modified oligonucleotide; wherein the conjugate group is a THA-GalNAc$_3$ that is directly attached to the 5' end of the modified oligonucleotide through a phosphodiester linkage, (THA-GalNAc$_3$)o; wherein (THA-GalNAc$_3$)o is represented by the following structure:

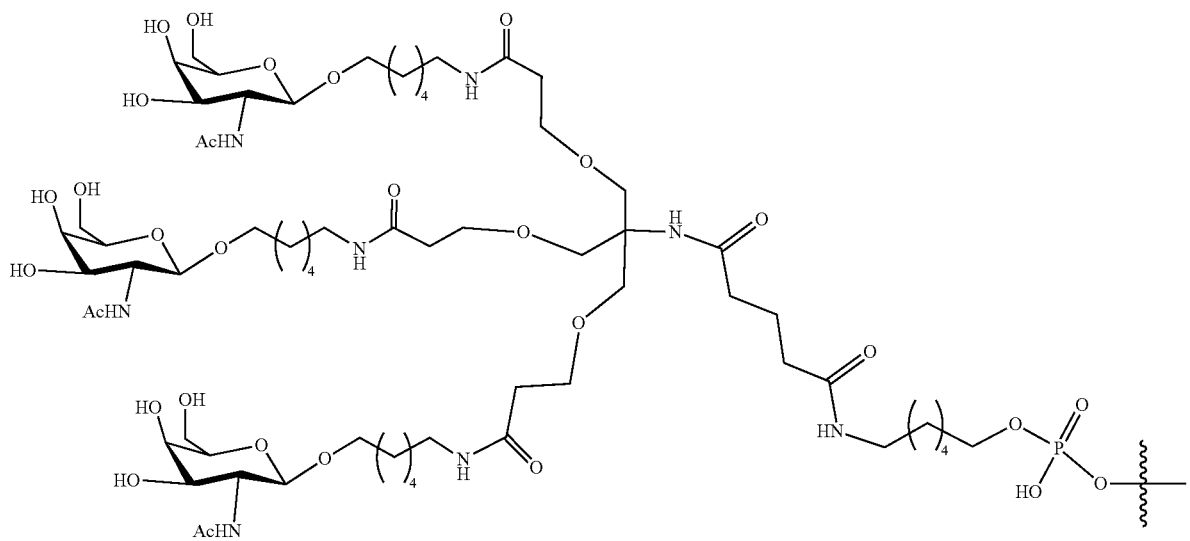

wherein the modified oligonucleotide is gapmer, having a sequence of (from 5' to 3') GCACUTTATTGAGTTC (incorporated herein as SEQ ID NO: 5006); wherein each of nucleosides 1-3 and 14-16 (from 5' to 3') comprise a cEt modified sugar moiety, each of nucleosides 4 and 6-13 are 2'-β-D-deoxynucleosides, and nucleoside 5 comprises a 2'-O-methyl sugar moiety; wherein each internucleoside linkage is a phosphorothioate internucleoside linkage, and wherein each cytosine is a 5-methyl cytosine.

In certain embodiments, Compound No. 1270705 is represented by the following chemical notation: (THA-GalNAc$_3$)o Gks $^m$Cks Aks $^m$Cds Uys Tds Tds Ads Tds Tds Gds Ads Gds Tks Tks $^m$Ck, wherein:
- A=an adenine nucleobase,
- $^m$C=a 5-methyl cytosine nucleobase,
- G=a guanine nucleobase,
- T=a thymine nucleobase,
- U=a uracil nucleobase,
- k=a cEt modified sugar moiety,
- y=a 2'-O-methyl modified ribosyl sugar moiety,
- d=a 2'-β-D-deoxyribosyl sugar moiety, and
- s=a phosphorothioate internucleoside linkage.

In certain embodiments, provided is an oligomeric compound comprising a modified oligonucleotide and a conjugate group according to the following chemical notation: (THA-GalNAc$_3$)o Gks $^m$Cks Aks $^m$Cds Uys Tds Tds Ads Tds Tds Gds Ads Gds Tks Tks $^m$Ck, wherein:
- A=an adenine nucleobase,
- $^m$C=a 5-methyl cytosine nucleobase,
- G=a guanine nucleobase,
- T=a thymine nucleobase,
- U=a uracil nucleobase,
- k=a cEt modified sugar moiety,
- y=a 2'-O-methyl modified ribosyl sugar moiety,
- d=a 2'-β-D-deoxyribosyl sugar moiety, and
- s=a phosphorothioate internucleoside linkage;

and wherein (THA-GalNAc$_3$)o=

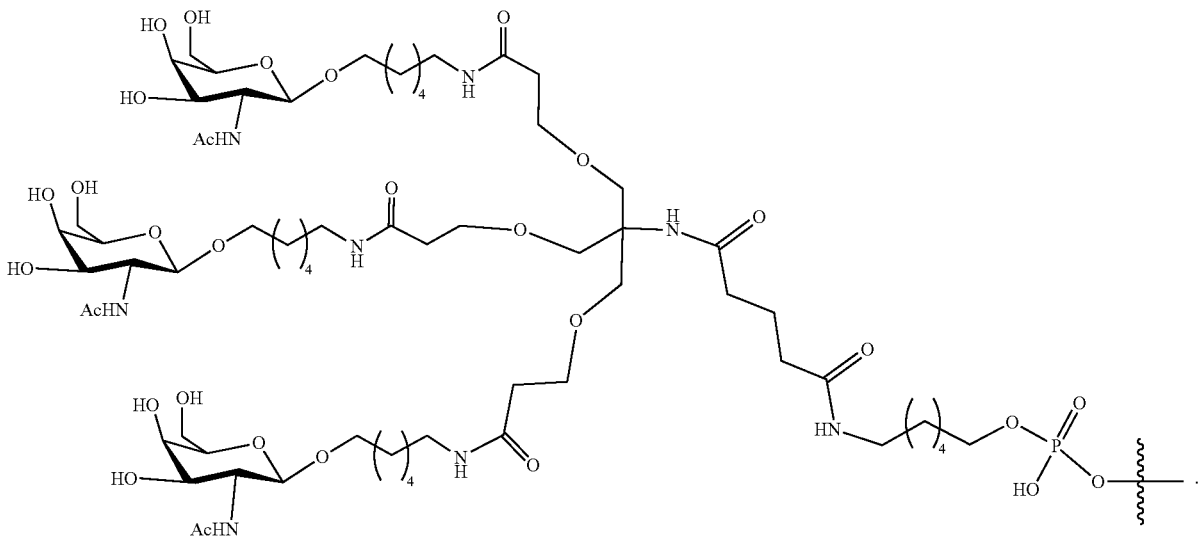

In certain embodiments, Compound No. 1270705 is represented by the following chemical structure:
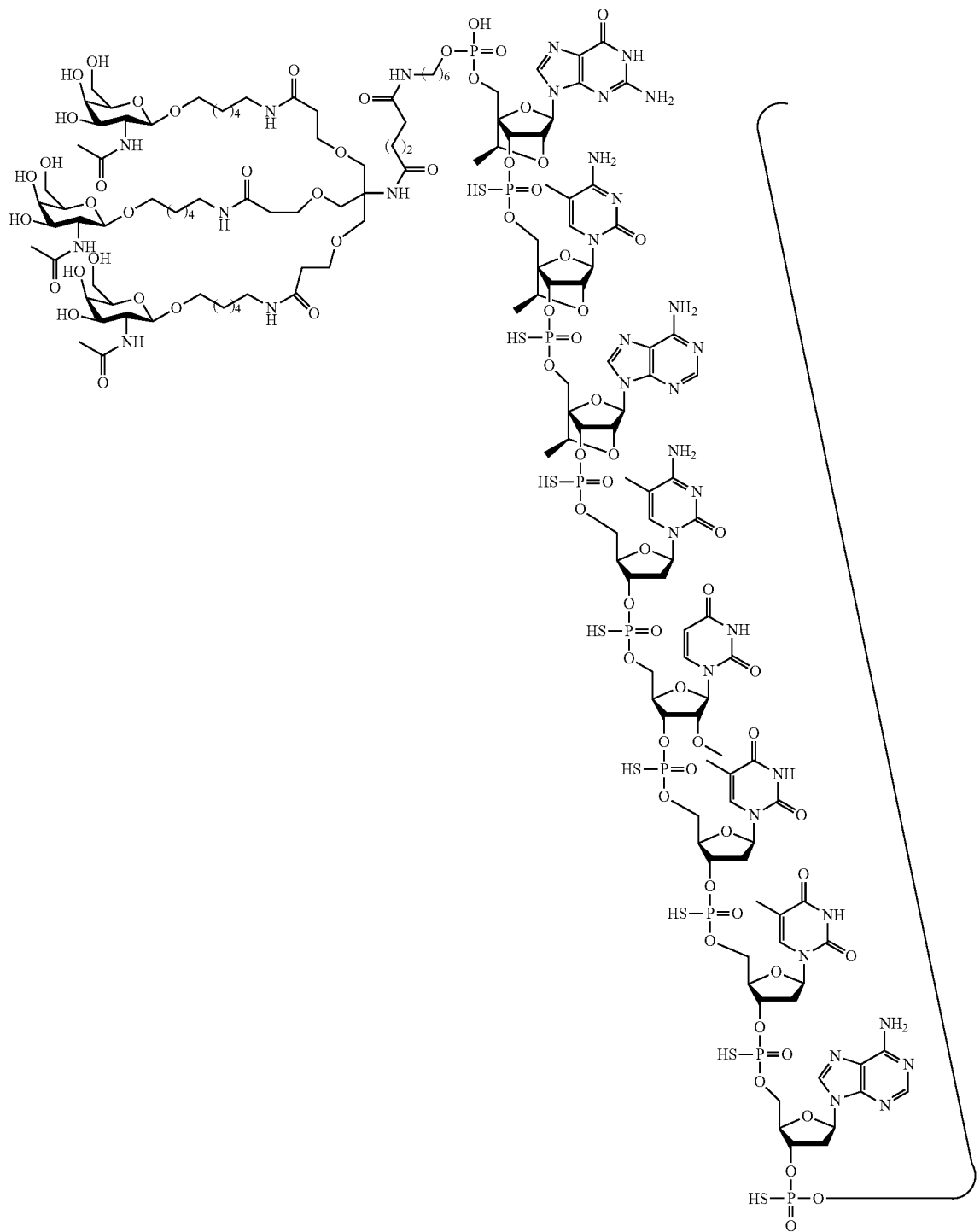

-continued
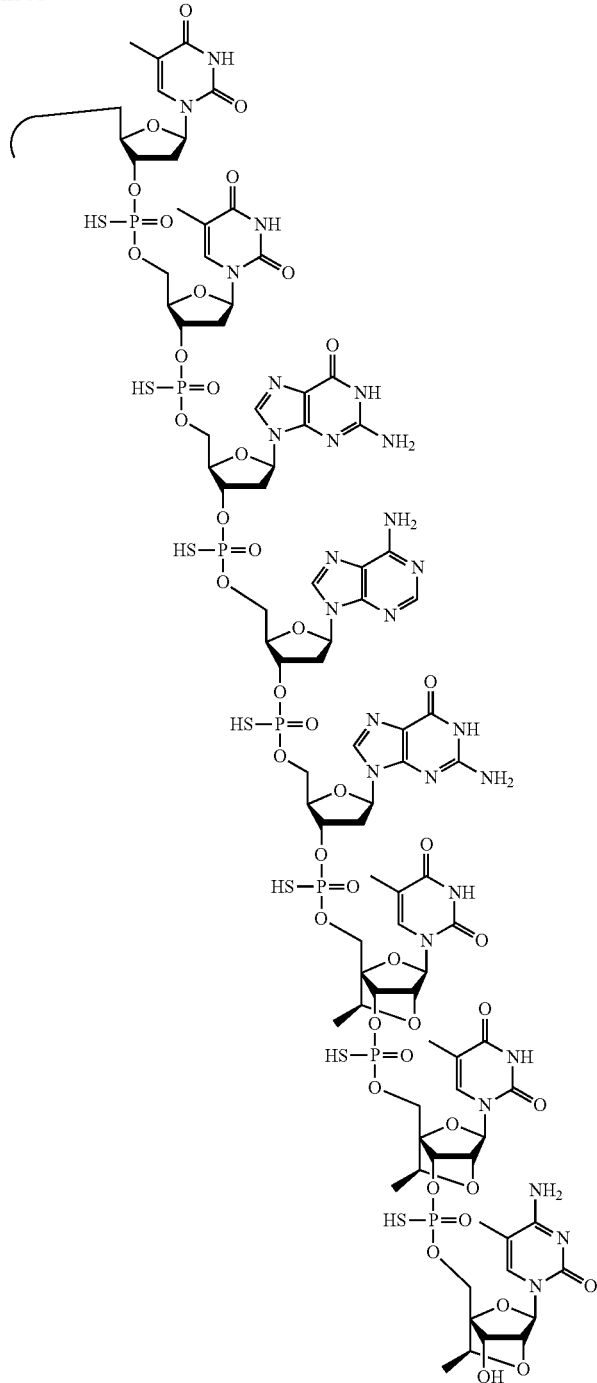 [SMILES: CC[C@H]1O[C@@H](n2cc(C)c(=O)[nH]c2=O)C[C@H]1OP(=O)(S)OC[C@H]1O[C@@H](n2cc(C)c(=O)[nH]c2=O)C[C@H]1OP(=O)(S)OC[C@H]1O[C@@H](n2cnc3c(=O)[nH]c(N)nc32)C[C@H]1OP(=O)(S)OC[C@H]1O[C@@H](n2cnc3c(N)ncnc32)C[C@H]1OP(=O)(S)OC[C@H]1O[C@@H](n2cnc3c(=O)[nH]c(N)nc32)C[C@H]1OP(=O)(S)OC[C@]12O[C@@H](n3cc(C)c(=O)[nH]c3=O)C(O[C@H]1C)[C@H]2OP(=O)(S)OC[C@]12O[C@@H](n3cc(C)c(=O)[nH]c3=O)C(O[C@H]1C)[C@H]2OP(=O)(S)OC[C@]12O[C@@H](n3cc(C)c(N)nc3=O)C(O[C@H]1C)[C@H]2O]
(SEQ ID NO: 5006).
Structure 3. Compound No. 1270705
In certain embodiments, the sodium salt of Compound No. 1270705 is represented by the following chemical structure:

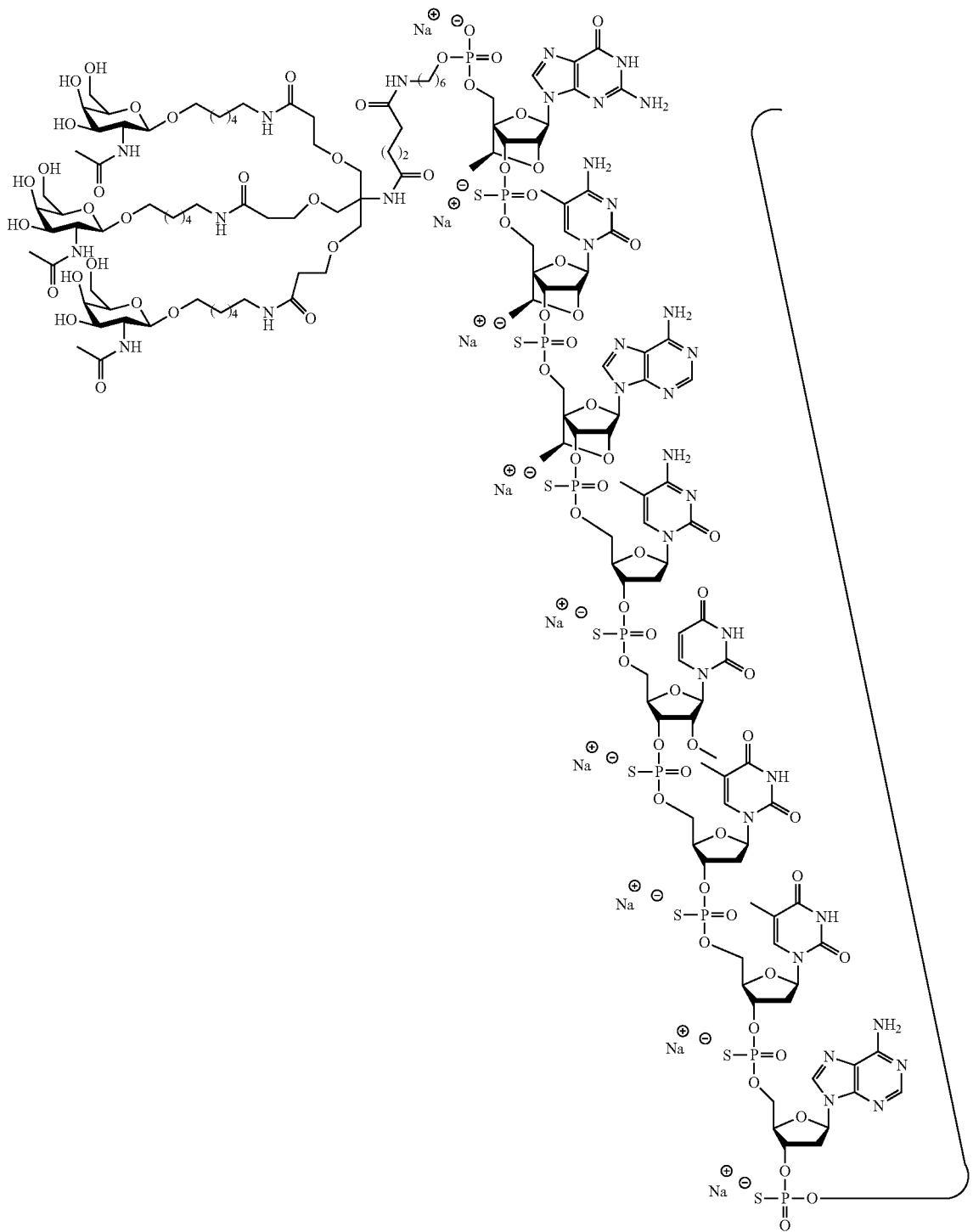

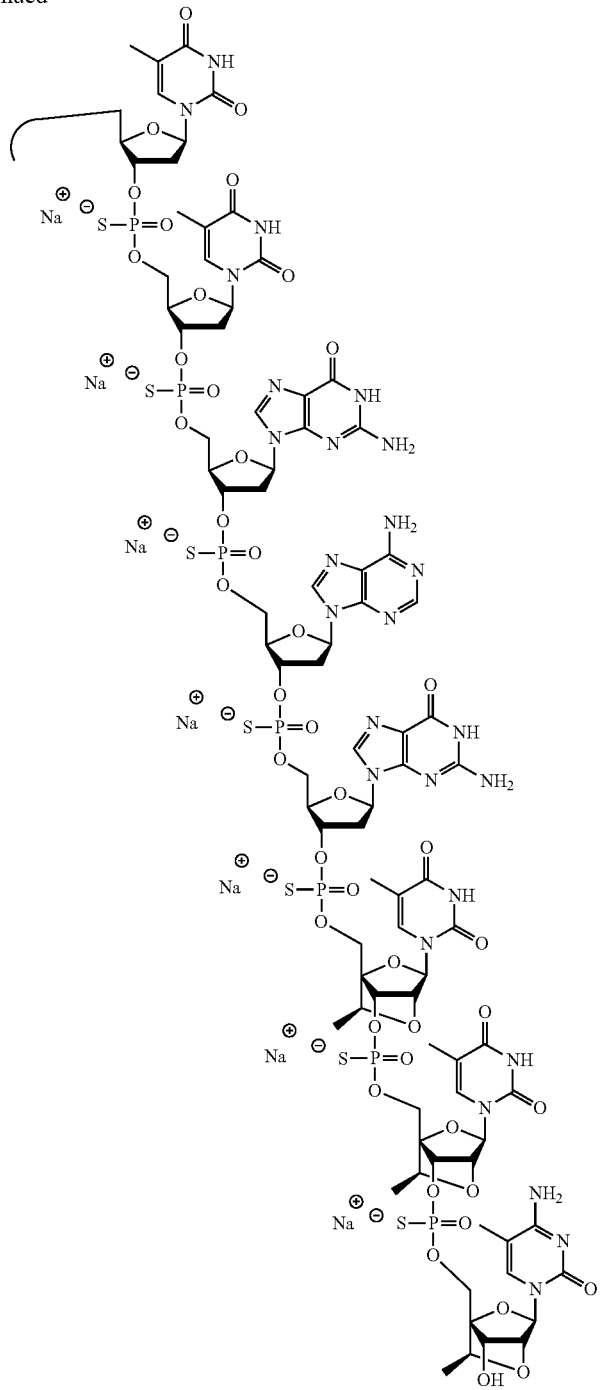

(SEQ ID NO: 5006).
Structure 4. The sodium salt of Compound No. 1270705
VIII. Certain Comparator Compounds Comparator Compound Nos. 1213029, 1213030, 1213034, and 1358035 (relating to Compound Nos. A-145667, A-145668, A-145676, and A-145669, respectively) were selected as comparator compounds from Example 1 of WO2017/120397 (incorporated herein by reference).

In certain embodiments, Compound No. 1213029, a surrogate of which (Compound A-145667) is provided in WO2017/120397, was used as a comparator compound, see Example 14. Compound No. 1213029 is a gapmer having a sugar motif of (from 5' to 3') yyyyydddddddddddyyyyy, wherein each "y" represents a 2'-O-methyl sugar moiety and each "d" represents a 2'-β-D-deoxyribosyl sugar moiety; having a sequence of (from 5' to 3') GAAUAC-CAAGGAGGGAAAG (SEQ ID NO: 5042), wherein each "C" of the gap is a 5-methyl cytosine; and wherein each internucleoside linkage is a phosphorothioate internucleoside linkage.

In certain embodiments, Compound No. 1213030, a surrogate of which (Compound A-145668) is provided in WO2017/120397, was used as a comparator compound, see Example 14. Compound No. 1213030 is a gapmer having a sugar motif of (from 5' to 3') yyyyyddddddddddyyyyy, wherein each "y" represents a 2'-O-methyl sugar moiety and each "d" represents a 2'-β-D-deoxyribosyl sugar moiety; having a sequence of (from 5' to 3') UCUCACTGCGGAAT-CACCAA (SEQ ID NO: 5041), wherein each "C" of the gap is a 5-methyl cytosine; and wherein each internucleoside linkage is a phosphorothioate internucleoside linkage.

In certain embodiments, Compound No. 1213034, a surrogate of which (Compound A-145676) is provided in WO2017/120397, was used as a comparator compound, see Example 14. Compound No. 1213034 is a gapmer having a sugar motif of (from 5' to 3') yyyyyddddddddddyyyyy, wherein each "y" represents a 2'-O-methyl sugar moiety and each "d" represents a 2'-β-D-deoxyribosyl sugar moiety; having a sequence of (from 5' to 3') CACUUTATT-GAGTTCCUGCG (SEQ ID NO: 5039), wherein each "C" of the gap is a 5-methyl cytosine; and wherein each internucleoside linkage is a phosphorothioate internucleoside linkage.

In certain embodiments, Compound No. 1358035, a surrogate of which (Compound A-145669) is provided in WO2017/120397, was used as a comparator compound, see Example 14. Compound No. 1358035 is a gapmer having a sugar motif of (from 5' to 3') yyyyyddddddddddyyyyy, wherein each "y" represents a 2'-O-methyl sugar moiety and each "d" represents a 2'-β-D-deoxyribosyl sugar moiety; having a sequence of (from 5' to 3') CCCCAGC-CACTCTCTCACUG (SEQ ID NO: 5040), wherein each "C" of the gap is a 5-methyl cytosine; and wherein each internucleoside linkage is a phosphorothioate internucleoside linkage.

In certain embodiments, compounds described herein are superior relative to comparator compounds described in WO2017/120397 because they demonstrate one or more improved properties, such as in vitro activity.

For example, as described herein, certain compounds, including Compound No. 1129485 and Compound No. 1213144, achieved IC50 values of 0.34 and 0.28, respectively, whereas each of comparator compounds Compound No. 1213029, Compound No. 1213030, Compound No. 1213034, and Compound No. 1358035 achieved IC50 values of >10, 8.15, >10, and 8.59, respectively, (see Table 154 in Example 14 for IC50 values). Therefore, certain compounds described herein are more potent than comparator compounds Compound No. 1213029, Compound No. 1213030, Compound No. 1213034, and Compound No. 1358035 in a multiple dose assay.

Compound No. 1194357 is identical to Compound No. 1129485, with the exception that Compound No. 1194357 comprises a conjugate group, and Compound No. 1270705 is identical to Compound No. 1213144, with the exception that Compound No. 1270705 comprises a conjugate group. Therefore, unconjugated versions of Compound No. 1129485 and Compound No. 1270705 are more active than comparator compounds Compound No. 1213029, Compound No. 1213030, Compound No. 1213034, and Compound No. 1358035 in a multiple dose assay.

IX. Certain Hotspot Regions

In certain embodiments, nucleobases in the ranges specified below comprise a hotspot region of FXII nucleic acid. In certain embodiments, modified oligonucleotides that are complementary to a hotspot region of a FXII nucleic acid achieve an average of more than 50% reduction of FXII RNA in vitro in a standard cell assay.

1. Nucleobases 1,899-1,979 of SEQ ID NO: 1

In certain embodiments, nucleobases 1,899-1,979 of SEQ ID NO: 1 comprise a hotspot region. In certain embodiments, modified oligonucleotides are complementary to a portion of nucleobases 1,899-1,979 of SEQ ID NO: 1. In certain embodiments, modified oligonucleotides are 20 nucleobases in length. In certain embodiments, modified oligonucleotides are 16 nucleobases in length. In certain embodiments, modified oligonucleotides are gapmers. In certain embodiments, the gapmers are MOE gapmers. In certain embodiments, the gapmers are cEt gapmers. In certain embodiments, the internucleoside linkages of the modified oligonucleotides are phosphorothioate internucleoside linkages and phosphodiester internucleoside linkages. In certain embodiments, each internucleoside linkage is a phosphorothioate internucleoside linkage.

The nucleobase sequences of SEQ ID NOs: 92, 156, 270, 271, 345, 346, 420, 421, 496, 497, 571, 572, 653, 654, 728, 729, 802, 803, 877, 951, 1028, 1103, 1179, 1253, 1330, 1407, 1484, 1560, 1636, 1710, 1711, 1784, 1859, 1860, 1934, 1935, 2008, 2009, 2084, 2085, 2158, 2232, 2233, 2307, 2308, 2393, 2394, 2395, 2396, 2397, 2398, 2461, 2537, 2538, 2614, 2615, 2691, 2692, 2768, 2769, 2845, 2846, 2921, 2922, 2997, 2998, 3073, 3074, 3144, 3145, 3226, 3227, 3303, 3304, 3379, 3380, 3455, 3456, 3531, 3607, 3683, 3759, 3835, 3911, 4948, 4949, 4954, 4955, 4956, 4957, 4961, 4965, 4966, 4967, 4971, 4972, 4976, 4994, 4995, 4996, 4997, 4998, 4999, 5024, 5025, 5026, 5027, 5028, and 5029 are complementary to nucleobases 1,899-1,979 of SEQ ID NO: 1.

The nucleobase sequences of Compound Nos: 1125047, 1125048, 1125049, 1125050, 1125051, 1125074, 1125075, 1125076, 1125077, 1125078, 1129474, 1129475, 1129476, 1129477, 1129478, 1129479, 1129480, 1129481, 1129482, 1129483, 1129484, 1129485, 1129486, 1129487, 1129488, 1129489, 1129490, 1129491, 1129492, 1129493, 1129494, 1129495, 1129496, 1129497, 1129498, 1129499, 1129500, 1129501, 1129502, 1129503, 1129504, 1129505, 1129506, 1131681, 1131682, 1131683, 1131684, 1131685, 1131686, 1131687, 1131688, 1131689, 1131690, 1131691, 1131692, 1131693, 1131694, 1131695, 1131696, 1131697, 1131698, 1131699, 1131700, 1131701, 1131702, 1131703, 1131704, 1131705, 1131706, 1131707, 1131708, 1131709, 1131710, 1131711, 1131712, 1131713, 1131714, 1131715, 1131716, 1131717, 1131718, 1131719, 1131720, 1131721, 1131722, 1131723, 1131724, 1131725, 1206454, 1206455, 1206456, 1206457, 1206458, 1206459, 1206485, 1206486, 1206487, 1206488, 1206489, 1206490, 1206491, 1206492, 1206505, 1206506, 1206507, 1206508, 1206509, 1206957, 1206958, 1206959, 1206960, 1206961, 1206962, 1206963, 1206964, 1206965, 1206966, 1206967, 1206968, 1206969, 1206970, 1206971, 1206972, 1206973, 1206974, 1206975, 1206976, 1206977, 1206978, 1206979, 1206980, 1206981, 1206982, 1206983, 1206985, 1206986, 1206987, 1206988, 1207098, 1207099, 1207100, 1207101, 1207102, 1207103, 1207104, 1207105, 1207106, 1207107, 1207108, 1207109, 1207110, 1207111, 1207112, 1207113, 1207114, 1207115, 1207116, 1207117, 1207118, 1207120, 1207123, 1207125, 1207127, 1207129, 1207131, 1207133, 1207135, 1207137, 1207139, 1207141, 1207228, 1207229, 1207230, 1207231, 1207232, 1207233, 1207234, 1207235, 1207236, 1207237, 1207238, 1207239, 1207240, 1207241, 1207242, 1207243, 1207244, 1207245, 1207246, 1207247, 1207248, 1207249, 1207250, 1207251, 1207252, 1207253, 1207254, 1207256, 1207257, 1207258, 1207259, 1207345, 1207346, 1207347, 1207348, 1207349, 1207350, 1207351, 1207352, 1207353, 1207354, 1207355, 1207356, 1207357, 1207358, 1207359, 1207360, 1207361, 1207362, 1207363, 1207364, 1207365, 1207366, 1207367, 1207368, 1207369, 1207370, 1207371, 1207372, 1207373, 1207374, 1207375, 1207376, 1207462, 1207463, 1207464, 1207465, 1207466, 1207467, 1207468, 1207469, 1207470, 1207471, 1207472, 1207473, 1207474, 1207475, 1207476, 1207477, 1207478, 1207479, 1207480, 1207481, 1207482, 1207483, 1207484, 1207485, 1207486, 1207487, 1207488, 1207489, 1207490, 1207491, 1207492, 1207493, 1213094, 1213095, 1213096, 1213097, 1213098, 1213099, 1213100, 1213101, 1213102, 1213103, 1213104, 1213105, 1213106, 1213107, 1213108, 1213109, 1213110, 1213111, 1213112, 1213113, 1213114, 1213115, 1213116, 1213117, 1213118, 1213119, 1213120, 1213121, 1213122, 1213123, 1213124, 1213125, 1213211, 1213212, 1213213, 1213214, 1213215, 1213216, 1213217, 1213218, 1213219, 1213220, 1213221, 1213222, 1213223, 1213224, 1213225, 1213226, 1213227, 1213228, 1213229, 1213230, 1213231, 1213232, 1213233, 1213234, 1213235, 1213236, 1213237, 1213238, 1213239, 1213240, 1213241, and 1213242 are complementary to nucleobases 1,899-1,979 of SEQ ID NO: 1.

In certain embodiments, modified oligonucleotides complementary to nucleobases 1,899-1,979 of SEQ ID NO: 1 achieve an average of 78% reduction of F12 mRNA in vitro in the standard cell assay.

2. Nucleobases 2,004-2,045 of SEO ID NO: 1

In certain embodiments, nucleobases 2,004-2,045 of SEQ ID NO: 1 comprise a hotspot region. In certain embodiments, modified oligonucleotides are complementary to nucleobases 2,004-2,045 of SEQ ID NO: 1.

The nucleobase sequences of SEQ ID NOs: 95, 159, 162, 163, 164, 165, 347, 422, 498, 573, 953, 1030, 1105, 1255, 1332, 1409, 1486, 1562, 2309, 2463, 2540, 2617, 2694, 2771, 2848, 2924, 3000, 3076, 3147, 3229, 3306, 3382, 3457, 3533, 3609, 3685, 3761, 3837, 3913, 5000, 5001, 5002, 5003, 5004, 5005, 5006, 5031, 5032, 5033, 5034, 5035, 5036, and 5037 are complementary to nucleobases 2,004-2,045 of SEQ ID NO: 1.

The modified oligonucleotides of Compound Nos: 462192, 1125101, 1125102, 1125103, 1125104, 1129526, 1129527, 1129528, 1129529, 1129530, 1129531, 1129532, 1129533, 1129534, 1129535, 1129536, 1129537, 1129538, 1129539, 1129540, 1129541, 1129542, 1129543, 1129544, 1129545, 1131745, 1131746, 1131747, 1131748, 1131749, 1131750, 1131751, 1131752, 1131753, 1131754, 1131755, 1131756, 1131757, 1131758, 1131759, 1131760, 1131761, 1131762, 1131763, 1206993, 1206994, 1206995, 1206996, 1206997, 1206998, 1206999, 1207000, 1207001, 1207002, 1207003, 1207004, 1207005, 1207006, 1207007, 1207008, 1207010, 1207011, 1207012, 1207147, 1207148, 1207149, 1207150, 1207151, 1207152, 1207153, 1207154, 1207155, 1207156, 1207157, 1207158, 1207159, 1207160, 1207161, 1207162, 1207163, 1207164, 1207165, 1207166, 1207264, 1207265, 1207266, 1207267, 1207268, 1207269, 1207270, 1207271, 1207272, 1207273, 1207274, 1207275, 1207276, 1207277, 1207278, 1207279, 1207280, 1207281, 1207282, 1207283, 1207381, 1207382, 1207383, 1207384, 1207385, 1207386, 1207387, 1207388, 1207389, 1207390, 1207391, 1207392, 1207393, 1207394, 1207395, 1207396, 1207397, 1207398, 1207399, 1207400, 1207498, 1207499, 1207500, 1207501, 1207502, 1207503, 1207504, 1207505, 1207506, 1207507, 1207508, 1207509, 1207511, 1207512, 1207513, 1207514, 1207515, 1207516, 1207517, 1213130, 1213131, 1213132, 1213133, 1213134, 1213135, 1213136, 1213137, 1213138, 1213139, 1213140, 1213141, 1213142, 1213143, 1213144, 1213145, 1213146, 1213147, 1213148, 1213149, 1213247, 1213248, 1213249, 1213250, 1213251, 1213252, 1213253, 1213254, 1213255, 1213256, 1213257, 1213258, 1213259, 1213260, 1213261, 1213262, 1213263, 1213264, 1213265, and 1213266 are complementary to nucleobases 2,004-2,045 of SEQ ID NO: 1.

In certain embodiments, modified oligonucleotides complementary to nucleobases 2,004-2,045 of SEQ ID NO: 1 achieve an average of 80% reduction of F12 mRNA in vitro in the standard cell assay.

X. Certain Indications

In certain embodiments, methods comprise administering a pharmaceutical composition described herein to a subject with a thromboembolic condition. Thromboembolic conditions include, but are not limited to, myocardial infarction (MI), stroke, limb ischemia and necrosis, and venous thromboembolism (VTE), including deep vein thrombosis (DVT) and pulmonary embolism (PE).

In certain embodiments, methods comprise administering a pharmaceutical composition described herein to a subject having a risk factor for developing a thromboembolic condition. In certain embodiments, the risk factor is genetic, health-associated, or environmental, or a combination thereof. In certain embodiments, the risk factor is surgery, malignancy, pregnancy, aging, use of oral contraceptives, immobility (including travel-related immobility), sepsis, having a mechanical heart valve, valvular heart disease, atrial fibrillation, atherosclerosis, antiphospholipid syndrome, an inherited clotting disorder (e.g., Factor V Leiden), or an acquired prothrombotic clotting disorder. Identifying a subject with a risk factor for developing a thromboembolic condition may be accomplished by evaluating a subject's medical history and/or by conducting standard clinical tests or assessments.

In certain embodiments, methods comprise administering a pharmaceutical composition described herein to a subject who has been identified as in need of anticoagulation therapy. Non-limiting examples of such subjects include a subject undergoing major orthopedic surgery (e.g., hip/knee replacement or hip fracture surgery) and a subject with atrial fibrillation.

Nonlimiting Disclosure and Incorporation by Reference

Each of the literature and patent publications listed herein is incorporated by reference in its entirety.

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH in place of one 2'-H of DNA) or as an RNA having a modified base (thymine (methylated uracil) in place of an uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "AT$^m$CGAUCG," wherein $^m$C indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as a or R such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, tautomeric forms of the compounds herein are also included unless otherwise indicated. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^1$H hydrogen atoms. Isotopic substitutions encompassed by the compounds herein include but are not limited to: $^2$H or $^3$H in place of $^1$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif And, for example, where a particular high-affinity modification appears at a particular position, other high-affinity modifications at the same position are considered suitable, unless otherwise indicated.

Example 1: Effects of 5-10-5 MOE Gapmers on Human FXII RNA In Vitro, Single Dose Modified oligonucleotides complementary to an FXII nucleic acid were synthesized and tested for their effect on FXII RNA levels in vitro. The modified oligonucleotides were tested in a series of experiments using culture conditions as indicated. The results for each separate experiment are presented in separate tables below.

The modified oligonucleotides in the tables below are 5-10-5 MOE gapmers (i.e., they have a central region of ten 2'-deoxynucleosides flanked on each side by wings, each comprising five 2'-MOE nucleosides). The motif for the gapmers is (from 5' to 3'): eeeeedddddddddddeeeee; wherein "d" represents a 2'-β-D-deoxyribosyl sugar moiety, and 'e' represents a 2'-MOE sugar moiety. The internucleoside linkages throughout each modified oligonucleotide are phosphorothioate linkages. All cytosine nucleobases throughout each modified oligonucleotide are 5-methylcytosines.

"Start site" indicates the 5'-most nucleoside of the target sequence to which the modified oligonucleotide is complementary. "Stop site" indicates the 3'-most nucleoside of the target sequence to which the modified oligonucleotide is complementary. As shown in the tables below, the modified oligonucleotides are 100% complementary to one or more human FXII target sequences, including the human FXII mRNA sequence designated herein as SEQ ID NO: 1 (ENSEMBL ID ENST00000253496.3 from ENSEMBL version 99: January 2020), the human FXII genomic sequence, designated herein as SEQ ID NO: 2 (ENSEMBL ID ENSG00000131187.9 from ENSEML version 99: January 2020), the human FXII genomic sequence, designated herein as SEQ ID NO: 3 (the complement of GENBANK Accession No. NC_000005.10 truncated from truncated from nucleotides 177399001 to 177413000), and the human FXII mRNA sequence designated herein as SEQ ID NO: 4 (GENBANK Accession No. NM_000505.3). 'N/A' indicates that the modified oligonucleotide is not complementary to that particular target sequence with 100% complementarity.

Cultured Huh7 cells were transfected either with lipofectin, oligofectamine, or by electroporation, as indicated in the tables below. In some cases, Huh7 cells, at a density of 8,000 cells per well, were transfected using lipofectin with 120 nM modified oligonucleotide. In other cases, Huh7 cells, at a density of 5,000 cells per well, were transfected using oligofectamine with 200 nM modified oligonucleotide. In other cases, Huh7 cells, at a density of 20,000 cells per well, were transfected using electroporation with 5000 nM modified oligonucleotide. After a treatment period of approximately 24 hours, RNA was isolated from the cells and FXII RNA levels were measured by quantitative real-time RTPCR. Either human primer probe set RTS2992 (forward sequence GTCAACACTTTCGATTCCACCTT, designated herein as SEQ ID NO: 5; reverse sequence TCCCCGGTGACAGTGAGAAC, designated herein as SEQ ID NO: 6; probe sequence AAGCCCCCAAGGAGCATAAGTACAAAGCTG, designated herein as SEQ ID NO: 7) or human primer probe set RTS40528 (forward sequence GTGCACGGATCCTCCATC, designated herein as SEQ ID NO: 8; reverse sequence CAGCTTGGTCCTCACACAC, designated herein as SEQ ID NO: 9; probe sequence AATCACCCTGGCACGCATCG, designated herein as SEQ ID NO: 10) was used to measure RNA levels. FXII RNA levels were normalized to total RNA content, as measured by RIBOGREEN®. Reduction of FXII RNA is presented in the tables below as percent FXII RNA relative to the amount in untreated control cells (% UTC). The symbol "†" indicates that the modified oligonucleotide is complementary to the target transcript within the amplicon region of the primer probe set. In such instances, additional assays using alternative primer probes must be performed to accurately assess the potency and efficacy of such modified oligonucleotides.

TABLE 1

Reduction of FXII RNA by 5-10-5 MOE gapmers with full PS internucleoside linkages (Huh7, lipofectin, 120 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS2992 | SEQ ID NO |
|---|---|---|---|---|---|---|---|
| 413577 | 1 | 20 | 1 | 20 | CCAGGAGTCCAGATCAATAG | 62 | 20 |
| 413578 | 67 | 86 | 67 | 86 | TCACCAGCAGGAACCCCAGG | 21 | 21 |
| 413579 | 92 | 111 | N/A | N/A | GGAATCGAAAGTGTTGACTC | 19† | 22 |
| 413580 | 159 | 178 | N/A | N/A | GGTGACAGTGAGAACGACTG | 6† | 23 |
| 413581 | 164 | 183 | 3515 | 3534 | TCCCCGGTGACAGTGAGAAC | 3† | 24 |
| 413582 | 217 | 236 | 3568 | 3587 | GGGTACATTTGTGGTACAGC | 19 | 25 |
| 413583 | 227 | 246 | 3578 | 3597 | CGGCCCTTGTGGGTACATTT | 30 | 26 |
| 413584 | 237 | 256 | 3588 | 3607 | AGGGCCTGGCCGGCCCTTGT | 67 | 27 |
| 413585 | 291 | 310 | 3798 | 3817 | GTATCCCCATCGCTGGTCCT | 14 | 28 |
| 413586 | 325 | 344 | N/A | N/A | TGCAGTGGTCTTTCACTTTC | 19 | 29 |
| 413587 | 399 | 418 | 4207 | 4226 | TTGTGGACAGAGACAGTGGG | 27 | 30 |
| 413588 | 409 | 428 | 4217 | 4236 | CAGTGAGGTGTTGTGGACAG | 14 | 31 |
| 413589 | 452 | 471 | 4397 | 4416 | AGAAGCTGAGGCTCAAAGCA | 38 | 32 |
| 413590 | 462 | 481 | 4407 | 4426 | GAAAACCGGAGAAGCTGAG | 24 | 33 |
| 413591 | 515 | 534 | 4460 | 4479 | TGGCATCTGGCCACAGCTGC | 20 | 34 |
| 413592 | 520 | 539 | 4465 | 4484 | TGCACTGGCATCTGGCCACA | 33 | 35 |
| 413593 | 528 | 547 | 4473 | 4492 | AGGACCCTTGCACTGGCATC | 24 | 36 |
| 413594 | 538 | 557 | 4483 | 4502 | AGTGGGCATCAGGACCCTTG | 22 | 37 |
| 413595 | 548 | 567 | 4493 | 4512 | AGCCGCTGGCAGTGGGCATC | 57 | 38 |
| 413596 | 562 | 581 | N/A | N/A | AGGCCTGGCTGGCCAGCCGC | 112 | 39 |
| 413597 | 567 | 586 | N/A | N/A | GCGGCAGGCCTGGCTGGCCA | 31 | 40 |
| 413598 | 572 | 591 | N/A | N/A | TTGGTGCGGCAGGCCTGGCT | 48 | 41 |
| 413599 | 587 | 606 | 4671 | 4690 | CCATGGAGGCACGGGTTGGT | 19 | 42 |
| 413600 | 608 | 627 | 4692 | 4711 | TCCACCTCTAGGCAGCGACC | 19 | 43 |
| 413601 | 626 | 645 | 4710 | 4729 | TGGCACAGGCGGTGGCCCTC | 39 | 44 |
| 413602 | 695 | 714 | 4924 | 4943 | CCGCGGCCATCATAGCAGCT | 24 | 45 |
| 413603 | 700 | 719 | 4929 | 4948 | TGAGCCCGCGGCCATCATAG | 33 | 46 |
| 413604 | 705 | 724 | 4934 | 4953 | GTAGCTGAGCCCGCGGCCAT | 28 | 47 |
| 413605 | 713 | 732 | 4942 | 4961 | AGGCCGCGGTAGCTGAGCCC | 38 | 48 |
| 413606 | 718 | 737 | 4947 | 4966 | TGGCCAGGCCGCGGTAGCTG | 30 | 49 |
| 413607 | 723 | 742 | 4952 | 4971 | GGTCCTGGCCAGGCCGCGGT | 23 | 50 |
| 413608 | 746 | 765 | 4975 | 4994 | TGACAGGGCGCACCCGAGAG | 33 | 51 |
| 413609 | 751 | 770 | 4980 | 4999 | ACGGCTGACAGGGCGCACCC | 28 | 52 |
| 413610 | 808 | 827 | 5037 | 5056 | GTCCCAGTTCCGCGCTTGC | 21 | 53 |
| 413611 | 818 | 837 | 5047 | 5066 | TGGCCGCCCAGTCCCCAGTT | 29 | 54 |

TABLE 1-continued

Reduction of FXII RNA by 5-10-5 MOE gapmers with full PS internucleoside linkages (Huh7, lipofectin, 120 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS2992 | SEQ ID NO |
|---|---|---|---|---|---|---|---|
| 413612 | 839 | 858 | N/A | N/A | TCCGGGTTCCGGCAGAAGGC | 20 | 55 |
| 413613 | 863 | 882 | 5177 | 5196 | AAGCACCACGGGCGGATGTC | 29 | 56 |
| 413614 | 871 | 890 | 5185 | 5204 | TCAGCACGAAGCACCACGGG | 13 | 57 |
| 413615 | 978 | 997 | 5292 | 5311 | CATGAGTGGGACATGAAGCC | 38 | 58 |
| 413616 | 1119 | 1138 | 5538 | 5557 | GAGCCGCTGCCCGCAGCTCA | 31 | 59 |
| 413617 | 1132 | 1151 | 5551 | 5570 | ACAGACTCTTGCGGAGCCGC | 19 | 60 |
| 413618 | 1137 | 1156 | 5556 | 5575 | CGAAGACAGACTCTTGCGGA | 22 | 61 |
| 413619 | 1142 | 1161 | 5561 | 5580 | GTCATCGAAGACAGACTCTT | 28 | 62 |
| 413620 | 1211 | 1230 | 5630 | 5649 | TGGCCCCAGTACAGCGCGGC | 27 | 63 |
| 413621 | 1231 | 1250 | 5650 | 5669 | GGCTGCCGGCGCAGAAACTG | 32 | 64 |
| 413622 | 1236 | 1255 | 5655 | 5674 | GATGAGGCTGCCGGCGCAGA | 25 | 65 |
| 413623 | 1283 | 1302 | N/A | N/A | GGCCGGTCCTGCAGGCAGTG | 28 | 66 |
| 413624 | 1304 | 1323 | 5964 | 5983 | ACCGTCAGATCCTCGGGTGC | 33 | 67 |
| 413625 | 1379 | 1398 | 6039 | 6058 | TGCAAGCGGTAGGAGCGCAC | 32 | 68 |
| 413626 | 1429 | 1448 | N/A | N/A | GGCGCAACAGAGCCAGGTCG | 100 | 69 |
| 413627 | 1455 | 1474 | 6198 | 6217 | GCAGCTGCCGTCCGCATCCT | 28 | 70 |
| 413628 | 1466 | 1485 | 6209 | 6228 | GACAGGAGCGCGCAGCTGCC | 25 | 71 |
| 413629 | 1492 | 1511 | 6235 | 6254 | GCAGGCACACCGGCTGAACG | 19 | 72 |
| 413630 | 1502 | 1521 | 6245 | 6264 | GCGCCGCTTGGCAGGCACAC | 28 | 73 |
| 413631 | 1559 | 1578 | 6302 | 6321 | TCGAACTGGTGGCCCCAGCC | 30 | 74 |
| 413632 | 1679 | 1698 | 6977 | 6996 | CCTGCGCAGAGCATGCCGGG | 50 | 75 |
| 413633 | 1684 | 1703 | 6982 | 7001 | GGAACCCTGCGCAGAGCATG | 17 | 76 |
| 413634 | 1689 | 1708 | 6987 | 7006 | CTCGAGGAACCCTGCGCAGA | 36 | 77 |
| 413635 | 1695 | 1714 | 6993 | 7012 | GCCGCCCTCGAGGAACCCTG | 14 | 78 |
| 413636 | 1743 | 1762 | 7131 | 7150 | GTCCTCACACACCAGCGGGC | 16 | 79 |
| 413637 | 1748 | 1767 | 7136 | 7155 | GCTTGGTCCTCACACACCAG | 18 | 80 |
| 413638 | 1774 | 1793 | 7162 | 7181 | CTTGCAGGGTGAGCCGGCGC | 45 | 81 |
| 413639 | 1779 | 1798 | 7167 | 7186 | GATGCCTTGCAGGGTGAGCC | 29 | 82 |
| 413640 | 1809 | 1828 | 7197 | 7216 | GCGGTCACCACAGCCCGATC | 25 | 83 |
| 413641 | 1814 | 1833 | 7202 | 7221 | TTGTTGCGGTCACCACAGCC | 23 | 84 |
| 413642 | 1820 | 1839 | 7208 | 7227 | CCTGGCTTGTTGCGGTCACC | 141 | 85 |
| 413643 | 1839 | 1858 | 7227 | 7246 | GGCCACATCGGTGTAGACGC | 16 | 86 |
| 413644 | 1844 | 1863 | 7232 | 7251 | TAGTAGGCCACATCGGTGTA | 32 | 87 |
| 413645 | 1849 | 1868 | 7237 | 7256 | CCAGGTAGTAGGCCACATCG | 21 | 88 |
| 413646 | 1854 | 1873 | 7242 | 7261 | CCAGGCCAGGTAGTAGGCCA | 38 | 89 |

TABLE 1-continued

Reduction of FXII RNA by 5-10-5 MOE gapmers with full PS internucleoside linkages (Huh7, lipofectin, 120 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS2992 | SEQ ID NO |
|---|---|---|---|---|---|---|---|
| 413647 | 1859 | 1878 | 7247 | 7266 | CGGATCCAGGCCAGGTAGTA | 33 | 90 |
| 413648 | 1891 | 1910 | 7279 | 7298 | AGTCCCTGAGCAATCAGGAA | 19 | 91 |
| 413649 | 1901 | 1920 | 7289 | 7308 | GGGAAAGATGAGTCCCTGAG | 14 | 92 |
| 413650 | 1992 | 2011 | 7380 | 7399 | ATCCTGGCGCGGAGCTGGCC | 13 | 93 |
| 413651 | 2002 | 2021 | 7390 | 7409 | TTCCTGCGCCATCCTGGCGC | 23 | 94 |
| 413652 | 2012 | 2031 | 7400 | 7419 | CTTTATTGAGTTCCTGCGCC | 15 | 95 |
| 413653 | 2022 | 2041 | 7410 | 7429 | TTTCAAAGCACTTTATTGAG | 11 | 96 |
| 413654 | 2027 | 2046 | 7415 | 7434 | AGCATTTTCAAAGCACTTTA | 23 | 97 |

TABLE 2

Reduction of FXII RNA by 5-10-5 MOE gapmers with full PS internucleoside linkages (Huh7, oligofectamine, 200 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS2992 | SEQ ID NO |
|---|---|---|---|---|---|---|---|
| 413627 | 1455 | 1474 | 6198 | 6217 | GCAGCTGCCGTCCGCATCCT | 27 | 70 |
| 413633 | 1684 | 1703 | 6982 | 7001 | GGAACCCTGCGCAGAGCATG | 41 | 76 |
| 413635 | 1695 | 1714 | 6993 | 7012 | GCCGCCCTCGAGGAACCCTG | 34 | 78 |
| 413643 | 1839 | 1858 | 7227 | 7246 | GGCCACATCGGTGTAGACGC | 23 | 86 |
| 413648 | 1891 | 1910 | 7279 | 7298 | AGTCCCTGAGCAATCAGGAA | 33 | 91 |
| 413649 | 1901 | 1920 | 7289 | 7308 | GGGAAAGATGAGTCCCTGAG | 18 | 92 |
| 413652 | 2012 | 2031 | 7400 | 7419 | CTTTATTGAGTTCCTGCGCC | 14 | 95 |
| 462131 | 1128 | 1147 | 5547 | 5566 | ACTCTTGCGGAGCCGCTGCC | 23 | 98 |
| 462132 | 1145 | 1164 | 5564 | 5583 | CGGGTCATCGAAGACAGACT | 39 | 99 |
| 462133 | 1148 | 1167 | 5567 | 5586 | ACGCGGGTCATCGAAGACAG | 24 | 100 |
| 462134 | 1151 | 1170 | 5570 | 5589 | ACGACGCGGGTCATCGAAGA | 52 | 101 |
| 462135 | 1154 | 1173 | 5573 | 5592 | CCAACGACGCGGGTCATCGA | 57 | 102 |
| 462136 | 1157 | 1176 | 5576 | 5595 | CCGCCAACGACGCGGGTCAT | 51 | 103 |
| 462137 | 1160 | 1179 | 5579 | 5598 | AGCCCGCCAACGACGCGGGT | 59 | 104 |
| 462138 | 1163 | 1182 | 5582 | 5601 | ACCAGCCCGCCAACGACGCG | 45 | 105 |
| 462139 | 1166 | 1185 | 5585 | 5604 | GCCACCAGCCCGCCAACGAC | 46 | 106 |
| 462140 | 1202 | 1221 | 5621 | 5640 | TACAGCGCGGCGATGTAGGG | 44 | 107 |
| 462141 | 1205 | 1224 | 5624 | 5643 | CAGTACAGCGCGGCGATGTA | 61 | 108 |
| 462142 | 1208 | 1227 | 5627 | 5646 | CCCCAGTACAGCGCGGCGAT | 30 | 109 |

TABLE 2-continued

Reduction of FXII RNA by 5-10-5 MOE gapmers with full PS internucleoside linkages (Huh7, oligofectamine, 200 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS2992 | SEQ ID NO |
|---|---|---|---|---|---|---|---|
| 462143 | 1214 | 1233 | 5633 | 5652 | CTGTGGCCCCAGTACAGCGC | 28 | 110 |
| 462144 | 1217 | 1236 | 5636 | 5655 | AAACTGTGGCCCCAGTACAG | 42 | 111 |
| 462145 | 1223 | 1242 | 5642 | 5661 | GCGCAGAAACTGTGGCCCCA | 20 | 112 |
| 462146 | 1226 | 1245 | 5645 | 5664 | CCGGCGCAGAAACTGTGGCC | 41 | 113 |
| 462147 | 1239 | 1258 | 5658 | 5677 | GGCGATGAGGCTGCCGGCGC | 22 | 114 |
| 462148 | 1374 | 1393 | 6034 | 6053 | GCGGTAGGAGCGCACGGCCA | 32 | 115 |
| 462149 | 1432 | 1451 | N/A | N/A | GAAGGCGCAACAGAGCCAGG | 61 | 116 |
| 462150 | 1435 | 1454 | N/A | N/A | CCTGAAGGCGCAACAGAGCC | 56 | 117 |
| 462151 | 1438 | 1457 | 6181 | 6200 | CCTCCTGAAGGCGCAACAGA | 48 | 118 |
| 462152 | 1444 | 1463 | 6187 | 6206 | CCGCATCCTCCTGAAGGCGC | 25 | 119 |
| 462153 | 1447 | 1466 | 6190 | 6209 | CGTCCGCATCCTCCTGAAGG | 50 | 120 |
| 462154 | 1450 | 1469 | 6193 | 6212 | TGCCGTCCGCATCCTCCTGA | 37 | 121 |
| 462155 | 1453 | 1472 | 6196 | 6215 | AGCTGCCGTCCGCATCCTCC | 39 | 122 |
| 462156 | 1454 | 1473 | 6197 | 6216 | CAGCTGCCGTCCGCATCCTC | 36 | 123 |
| 462157 | 1456 | 1475 | 6199 | 6218 | CGCAGCTGCCGTCCGCATCC | 22 | 124 |
| 462158 | 1457 | 1476 | 6200 | 6219 | GCGCAGCTGCCGTCCGCATC | 31 | 125 |
| 462159 | 1458 | 1477 | 6201 | 6220 | CGCGCAGCTGCCGTCCGCAT | 28 | 126 |
| 462160 | 1461 | 1480 | 6204 | 6223 | GAGCGCGCAGCTGCCGTCCG | 41 | 127 |
| 462161 | 1469 | 1488 | 6212 | 6231 | GGCGACAGGAGCGCGCAGCT | 25 | 128 |
| 462162 | 1472 | 1491 | 6215 | 6234 | TAAGGCGACAGGAGCGCGCA | 41 | 129 |
| 462163 | 1495 | 1514 | 6238 | 6257 | TTGGCAGGCACACCGGCTGA | 32 | 130 |
| 462164 | 1498 | 1517 | 6241 | 6260 | CGCTTGGCAGGCACACCGGC | 36 | 131 |
| 462165 | 1518 | 1537 | 6261 | 6280 | CTCGGAGGGTCGCGCGGCGC | 28 | 132 |
| 462166 | 1562 | 1581 | 6305 | 6324 | CCCTCGAACTGGTGGCCCCA | 42 | 133 |
| 462167 | 1596 | 1615 | 6894 | 6913 | CGCCTCCTGCAGGAAGCTGG | 33 | 134 |
| 462168 | 1599 | 1618 | 6897 | 6916 | CTGCGCCTCCTGCAGGAAGC | 38 | 135 |
| 462169 | 1602 | 1621 | 6900 | 6919 | TACCTGCGCCTCCTGCAGGA | 67 | 136 |
| 462170 | 1682 | 1701 | 6980 | 6999 | AACCCTGCGCAGAGCATGCC | 28 | 137 |
| 462171 | 1685 | 1704 | 6983 | 7002 | AGGAACCCTGCGCAGAGCAT | 36 | 138 |
| 462172 | 1686 | 1705 | 6984 | 7003 | GAGGAACCCTGCGCAGAGCA | 27 | 139 |
| 462173 | 1692 | 1711 | 6990 | 7009 | GCCCTCGAGGAACCCTGCGC | 38 | 140 |
| 462174 | 1693 | 1712 | 6991 | 7010 | CGCCCTCGAGGAACCCTGCG | 39 | 141 |
| 462175 | 1697 | 1716 | 6995 | 7014 | GTGCCGCCCTCGAGGAACCC | 44 | 142 |
| 462176 | 1698 | 1717 | 6996 | 7015 | GGTGCCGCCCTCGAGGAACC | 19 | 143 |
| 462177 | 1702 | 1721 | 7000 | 7019 | CATCGGTGCCGCCCTCGAGG | 50 | 144 |

TABLE 2-continued

Reduction of FXII RNA by 5-10-5 MOE gapmers with full PS internucleoside linkages (Huh7, oligofectamine, 200 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS2992 | SEQ ID NO |
|---|---|---|---|---|---|---|---|
| 462178 | 1840 | 1859 | 7228 | 7247 | AGGCCACATCGGTGTAGACG | 30 | 145 |
| 462179 | 1841 | 1860 | 7229 | 7248 | TAGGCCACATCGGTGTAGAC | 36 | 146 |
| 462180 | 1889 | 1908 | 7277 | 7296 | TCCCTGAGCAATCAGGAAAC | 31 | 147 |
| 462181 | 1890 | 1909 | 7278 | 7297 | GTCCCTGAGCAATCAGGAAA | 29 | 148 |
| 462182 | 1892 | 1911 | 7280 | 7299 | GAGTCCCTGAGCAATCAGGA | 39 | 149 |
| 462183 | 1893 | 1912 | 7281 | 7300 | TGAGTCCCTGAGCAATCAGG | 16 | 150 |
| 462184 | 1899 | 1918 | 7287 | 7306 | GAAAGATGAGTCCCTGAGCA | 34 | 151 |
| 462185 | 1900 | 1919 | 7288 | 7307 | GGAAAGATGAGTCCCTGAGC | 24 | 152 |
| 462186 | 1902 | 1921 | 7290 | 7309 | AGGGAAAGATGAGTCCCTGA | 25 | 153 |
| 462187 | 1903 | 1922 | 7291 | 7310 | GAGGGAAAGATGAGTCCCTG | 24 | 154 |
| 462188 | 1904 | 1923 | 7292 | 7311 | GGAGGGAAAGATGAGTCCCT | 21 | 155 |
| 462189 | 1947 | 1966 | 7335 | 7354 | TGCCTTCCATGCCCCAGCCA | 17 | 156 |
| 462190 | 1995 | 2014 | 7383 | 7402 | GCCATCCTGGCGCGGAGCTG | 23 | 157 |
| 462191 | 1998 | 2017 | 7386 | 7405 | TGCGCCATCCTGGCGCGGAG | 50 | 158 |
| 462192 | 2005 | 2024 | 7393 | 7412 | GAGTTCCTGCGCCATCCTGG | 13 | 159 |
| 462193 | 2008 | 2027 | 7396 | 7415 | ATTGAGTTCCTGCGCCATCC | 17 | 160 |
| 462194 | 2011 | 2030 | 7399 | 7418 | TTTATTGAGTTCCTGCGCCA | 22 | 161 |
| 462195 | 2013 | 2032 | 7401 | 7420 | ACTTTATTGAGTTCCTGCGC | 16 | 162 |
| 462196 | 2014 | 2033 | 7402 | 7421 | CACTTTATTGAGTTCCTGCG | 8 | 163 |
| 462197 | 2015 | 2034 | 7403 | 7422 | GCACTTTATTGAGTTCCTGC | 6 | 164 |
| 462198 | 2018 | 2037 | 7406 | 7425 | AAAGCACTTTATTGAGTTCC | 7 | 165 |
| 462199 | 2030 | 2049 | 7418 | 7437 | CTCAGCATTTTCAAAGCACT | 22 | 166 |

TABLE 3

Reduction of FXII RNA by 5-10-5 MOE gapmers with full PS internucleoside linkages (Huh7, oligofectamine, 200 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS2992 | SEQ ID NO |
|---|---|---|---|---|---|---|---|
| 413582 | 217 | 236 | 3568 | 3587 | GGGTACATTTGTGGTACAGC | 42 | 5 |
| 413592 | 520 | 539 | 4465 | 4484 | TGCACTGGCATCTGGCCACA | 57 | 35 |
| 413610 | 808 | 827 | 5037 | 5056 | GTCCCCAGTTCCGCGCTTGC | 45 | 43 |
| 413611 | 818 | 837 | 5047 | 5066 | TGGCCGCCCAGTCCCCAGTT | 77 | 54 |
| 413612 | 839 | 858 | N/A | N/A | TCCGGGTTCCGGCAGAAGGC | 68 | 55 |

TABLE 3-continued

Reduction of FXII RNA by 5-10-5 MOE gapmers with full PS internucleoside linkages (Huh7, oligofectamine, 200 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS2992 | SEQ ID NO |
|---|---|---|---|---|---|---|---|
| 413652 | 2012 | 2031 | 7400 | 7419 | CTTTATTGAGTTCCTGCGCC | 30 | 95 |
| 462056 | 55 | 74 | 55 | 74 | ACCCCAGGAGCAGCAGAGCC | 58 | 167 |
| 462057 | 58 | 77 | 58 | 77 | GGAACCCCAGGAGCAGCAGA | 67 | 168 |
| 462058 | 61 | 80 | 61 | 80 | GCAGGAACCCCAGGAGCAGC | 62 | 169 |
| 462059 | 64 | 83 | 64 | 83 | CCAGCAGGAACCCCAGGAGC | 76 | 170 |
| 462060 | 95 | 114 | N/A | N/A | GGTGGAATCGAAAGTGTTGA | 65† | 171 |
| 462061 | 98 | 117 | N/A | N/A | CAAGGTGGAATCGAAAGTGT | 63† | 172 |
| 462062 | 137 | 156 | 504 | 523 | TGCTCTTCAGCTTTGTACTT | 23† | 173 |
| 462063 | 140 | 159 | 507 | 526 | GTGTGCTCTTCAGCTTTGTA | 6† | 174 |
| 462064 | 143 | 162 | 510 | 529 | ACTGTGTGCTCTTCAGCTTT | 10† | 175 |
| 462065 | 146 | 165 | N/A | N/A | ACGACTGTGTGCTCTTCAGC | 9† | 176 |
| 462067 | 155 | 174 | N/A | N/A | ACAGTGAGAACGACTGTGTG | 30† | 177 |
| 462068 | 167 | 186 | 3518 | 3537 | GGCTCCCCGGTGACAGTGAG | 13† | 178 |
| 462069 | 170 | 189 | 3521 | 3540 | CAGGGCTCCCCGGTGACAGT | 14† | 179 |
| 462070 | 173 | 192 | 3524 | 3543 | TGGCAGGGCTCCCCGGTGAC | 16† | 180 |
| 462071 | 176 | 195 | 3527 | 3546 | AAGTGGCAGGGCTCCCCGGT | 70† | 181 |
| 462072 | 215 | 234 | 3566 | 3585 | GTACATTTGTGGTACAGCTG | 16 | 182 |
| 462073 | 216 | 235 | 3567 | 3586 | GGTACATTTGTGGTACAGCT | 24 | 183 |
| 462074 | 219 | 238 | 3570 | 3589 | GTGGGTACATTTGTGGTACA | 38 | 184 |
| 462075 | 223 | 242 | 3574 | 3593 | CCTTGTGGGTACATTTGTGG | 48 | 185 |
| 462076 | 230 | 249 | 3581 | 3600 | GGCCGGCCCTTGTGGGTACA | 65 | 186 |
| 462077 | 315 | 334 | 3822 | 3841 | TTTCACTTTCTTGGGCTCCA | 46 | 187 |
| 462078 | 318 | 337 | N/A | N/A | GTCTTTCACTTTCTTGGGCT | 59 | 188 |
| 462079 | 321 | 340 | N/A | N/A | GTGGTCTTTCACTTTCTTGG | 69 | 189 |
| 462080 | 448 | 467 | 4393 | 4412 | GCTGAGGCTCAAAGCACTTC | 42 | 190 |
| 462081 | 455 | 474 | 4400 | 4419 | CGGAGAAGCTGAGGCTCAAA | 71 | 191 |
| 462082 | 458 | 477 | 4403 | 4422 | AACCGGAGAAGCTGAGGCTC | 60 | 192 |
| 462083 | 465 | 484 | 4410 | 4429 | GTGGAAAACCGGAGAAGCT | 46 | 193 |
| 462084 | 486 | 505 | 4431 | 4450 | TCTATACCATATCTCATTCT | 57 | 194 |
| 462085 | 507 | 526 | 4452 | 4471 | GGCCACAGCTGCTTGCTCAG | 44 | 195 |
| 462086 | 518 | 537 | 4463 | 4482 | CACTGGCATCTGGCCACAGC | 51 | 196 |
| 462087 | 519 | 538 | 4464 | 4483 | GCACTGGCATCTGGCCACAG | 62 | 197 |
| 462088 | 521 | 540 | 4466 | 4485 | TTGCACTGGCATCTGGCCAC | 37 | 198 |
| 462089 | 522 | 541 | 4467 | 4486 | CTTGCACTGGCATCTGGCCA | 55 | 199 |
| 462090 | 523 | 542 | 4468 | 4487 | CCTTGCACTGGCATCTGGCC | 81 | 200 |

TABLE 3-continued

Reduction of FXII RNA by 5-10-5 MOE gapmers with full PS internucleoside linkages (Huh7, oligofectamine, 200 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS2992 | SEQ ID NO |
|---|---|---|---|---|---|---|---|
| 462091 | 534 | 553 | 4479 | 4498 | GGCATCAGGACCCTTGCACT | 35 | 201 |
| 462092 | 541 | 560 | 4486 | 4505 | GGCAGTGGGCATCAGGACCC | 59 | 202 |
| 462093 | 544 | 563 | 4489 | 4508 | GCTGGCAGTGGGCATCAGGA | 85 | 203 |
| 462094 | 575 | 594 | N/A | N/A | GGGTTGGTGCGGCAGGCCTG | 68 | 204 |
| 462095 | 578 | 597 | 4662 | 4681 | CACGGGTTGGTGCGGCAGGC | 65 | 205 |
| 462096 | 581 | 600 | 4665 | 4684 | AGGCACGGGTTGGTGCGGCA | 65 | 206 |
| 462097 | 584 | 603 | 4668 | 4687 | TGGAGGCACGGGTTGGTGCG | 105 | 207 |
| 462098 | 590 | 609 | 4674 | 4693 | CCCCCATGGAGGCACGGGTT | 32 | 208 |
| 462099 | 593 | 612 | 4677 | 4696 | CGACCCCATGGAGGCACGG | 51 | 209 |
| 462100 | 596 | 615 | 4680 | 4699 | CAGCGACCCCATGGAGGCA | 59 | 210 |
| 462101 | 599 | 618 | 4683 | 4702 | AGGCAGCGACCCCCATGGAG | 51 | 211 |
| 462102 | 602 | 621 | 4686 | 4705 | TCTAGGCAGCGACCCCCATG | 50 | 212 |
| 462103 | 605 | 624 | 4689 | 4708 | ACCTCTAGGCAGCGACCCCC | 59 | 213 |
| 462104 | 611 | 630 | 4695 | 4714 | CCCTCCACCTCTAGGCAGCG | 60 | 214 |
| 462105 | 614 | 633 | 4698 | 4717 | TGGCCCTCCACCTCTAGGCA | 47 | 215 |
| 462106 | 620 | 639 | 4704 | 4723 | AGGCGGTGGCCCTCCACCTC | 73 | 216 |
| 462107 | 623 | 642 | 4707 | 4726 | CACAGGCGGTGGCCCTCCAC | 27 | 217 |
| 462108 | 629 | 648 | 4713 | 4732 | CAGTGGCACAGGCGGTGGCC | 45 | 218 |
| 462109 | 632 | 651 | 4716 | 4735 | GGGCAGTGGCACAGGCGGTG | 54 | 219 |
| 462110 | 708 | 727 | 4937 | 4956 | GCGGTAGCTGAGCCCGCGGC | 81 | 220 |
| 462111 | 726 | 745 | 4955 | 4974 | CGTGGTCCTGGCCAGGCCGC | 61 | 221 |
| 462112 | 803 | 822 | 5032 | 5051 | CAGTTCCGCGCTTGCTCGGC | 51 | 222 |
| 462113 | 806 | 825 | 5035 | 5054 | CCCCAGTTCCGCGCTTGCTC | 44 | 223 |
| 462114 | 807 | 826 | 5036 | 5055 | TCCCCAGTTCCGCGCTTGCT | 69 | 224 |
| 462115 | 809 | 828 | 5038 | 5057 | AGTCCCCAGTTCCGCGCTTG | 55 | 225 |
| 462116 | 810 | 829 | 5039 | 5058 | CAGTCCCCAGTTCCGCGCTT | 56 | 226 |
| 462117 | 811 | 830 | 5040 | 5059 | CCAGTCCCCAGTTCCGCGCT | 40 | 227 |
| 462118 | 814 | 833 | 5043 | 5062 | CGCCCAGTCCCCAGTTCCGC | 60 | 228 |
| 462119 | 817 | 836 | 5046 | 5065 | GGCCGCCCAGTCCCCAGTTC | 57 | 229 |
| 462120 | 820 | 839 | 5049 | 5068 | CGTGGCCGCCCAGTCCCCAG | 43 | 230 |
| 462121 | 838 | 857 | N/A | N/A | CCGGGTTCCGGCAGAAGGCG | 59 | 231 |
| 462122 | 841 | 860 | N/A | N/A | TGTCCGGGTTCCGGCAGAAG | 95 | 232 |
| 462123 | 842 | 861 | N/A | N/A | TTGTCCGGGTTCCGGCAGAA | 96 | 233 |
| 462124 | 866 | 885 | 5180 | 5199 | ACGAAGCACCACGGGCGGAT | 85 | 234 |
| 462125 | 1002 | 1021 | 5316 | 5335 | CTTCGGCGGTGCCGGCTGCG | 57 | 235 |

TABLE 3-continued

Reduction of FXII RNA by 5-10-5 MOE gapmers with full PS internucleoside linkages (Huh7, oligofectamine, 200 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS2992 | SEQ ID NO |
|---|---|---|---|---|---|---|---|
| 462126 | 1122 | 1141 | 5541 | 5560 | GCGGAGCCGCTGCCCGCAGC | 80 | 236 |
| 462127 | 1125 | 1144 | 5544 | 5563 | CTTGCGGAGCCGCTGCCCGC | 79 | 237 |

TABLE 4

Reduction of FXII RNA by 5-10-5 MOE gapmers with full PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS40528 | SEQ ID NO |
|---|---|---|---|---|---|---|---|
| 413612 | 839 | 858 | N/A | N/A | TCCGGGTTCCGGCAGAAGGC | 31 | 55 |
| 462073 | 216 | 235 | 3567 | 3586 | GGTACATTTGTGGTACAGCT | 10 | 183 |
| 462192 | 2005 | 2024 | 7393 | 7412 | GAGTTCCTGCGCCATCCTGG | 22 | 159 |
| 1124163 | 32 | 51 | 32 | 51 | ATGGCATCCGTCCGTTGGTC | 70 | 238 |
| 1124191 | 78 | 97 | 78 | 97 | TGACTCCAAGCTCACCAGCA | 79 | 239 |
| 1124219 | 135 | 154 | 502 | 521 | CTCTTCAGCTTTGTACTTAT | 60 | 240 |
| 1124245 | 171 | 190 | 3522 | 3541 | GCAGGGCTCCCCGGTGACAG | 42 | 241 |
| 1124268 | 225 | 244 | 3576 | 3595 | GCCCTTGTGGGTACATTTGT | 79 | 242 |
| 1124296 | 290 | 309 | 3797 | 3816 | TATCCCCATCGCTGGTCCTG | 31 | 243 |
| 1124324 | 331 | 350 | N/A | N/A | GTTTGCTGCAGTGGTCTTTC | 25 | 244 |
| 1124352 | 404 | 423 | 4212 | 4231 | AGGTGTTGTGGACAGAGACA | 60 | 245 |
| 1124380 | 446 | 465 | 4391 | 4410 | TGAGGCTCAAAGCACTTCTC | 43 | 246 |
| 1124407 | 489 | 508 | 4434 | 4453 | AGTTCTATACCATATCTCAT | 32 | 247 |
| 1124435 | 532 | 551 | 4477 | 4496 | CATCAGGACCCTTGCACTGG | 54 | 248 |
| 1124462 | 566 | 585 | N/A | N/A | CGGCAGGCCTGGCTGGCCAG | 33 | 249 |
| 1124489 | 606 | 625 | 4690 | 4709 | CACCTCTAGGCAGCGACCCC | 21 | 250 |
| 1124517 | 653 | 672 | 4737 | 4756 | AAGGCTCCGGTGTAGCCCAC | 48 | 251 |
| 1124545 | 709 | 728 | 4938 | 4957 | CGCGGTAGCTGAGCCCGCGG | 65 | 252 |
| 1124572 | 762 | 781 | 4991 | 5010 | CTCCGAGGCCCACGGCTGAC | 39 | 253 |
| 1124620 | 902 | 921 | 5216 | 5235 | TCGCAGTACTCCCAGCTCAG | 19 | 254 |
| 1124648 | 993 | 1012 | 5307 | 5326 | TGCCGGCTGCGCGGGCATGA | 37 | 255 |
| 1124676 | 1071 | 1090 | 5490 | 5509 | CTGCTCCCGCTTCGCCGGCA | 79 | 256 |
| 1124704 | 1116 | 1135 | 5535 | 5554 | CCGCTGCCCGCAGCTCAGTG | 50 | 257 |
| 1124730 | 1152 | 1171 | 5571 | 5590 | AACGACGCGGGTCATCGAAG | 27 | 258 |
| 1124757 | 1224 | 1243 | 5643 | 5662 | GGCGCAGAAACTGTGGCCCC | 32 | 259 |

TABLE 4-continued

Reduction of FXII RNA by 5-10-5 MOE gapmers with full PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS40528 | SEQ ID NO |
|---|---|---|---|---|---|---|---|
| 1124784 | 1311 | 1330 | 5971 | 5990 | GAGCACCACCGTCAGATCCT | 30 | 260 |
| 1124812 | 1380 | 1399 | 6040 | 6059 | GTGCAAGCGGTAGGAGCGCA | 48 | 261 |
| 1124839 | 1459 | 1478 | 6202 | 6221 | GCGCGCAGCTGCCGTCCGCA | 27 | 262 |
| 1124863 | 1548 | 1567 | 6291 | 6310 | GCCCCAGCCGGCCACCTGGC | 149 | 263 |
| 1124890 | 1578 | 1597 | N/A | N/A | GGCATATTCCTCCGCCCCCT | 37 | 264 |
| 1124917 | 1620 | 1639 | 6918 | 6937 | CTCCAGGGAGAGGAACGGTA | 116 | 265 |
| 1124943 | 1746 | 1765 | 7134 | 7153 | TTGGTCCTCACACACCAGCG | 10† | 266 |
| 1124970 | 1793 | 1812 | 7181 | 7200 | GATCCCCAGCTGATGATGCC | 94 | 267 |
| 1124996 | 1823 | 1842 | 7211 | 7230 | ACGCCTGGCTTGTTGCGGTC | 24 | 268 |
| 1125021 | 1870 | 1889 | 7258 | 7277 | CGGTGTGCTCCCGGATCCAG | 50 | 269 |
| 1125047 | 1915 | 1934 | 7303 | 7322 | GGAATCACCAAGGAGGGAAA | 14 | 270 |
| 1125074 | 1950 | 1969 | 7338 | 7357 | TCTTGCCTTCCATGCCCCAG | 18 | 271 |
| 1125122 | N/A | N/A | 94 | 113 | CACTCACCGAAAGTGTTGAC | 40 | 272 |
| 1125150 | N/A | N/A | 178 | 197 | CCACAGGTCATGAGCAGAGG | 63 | 273 |
| 1125178 | N/A | N/A | 274 | 293 | TGCCCTTGTATCCACCCAGT | 71 | 274 |
| 1125206 | N/A | N/A | 368 | 387 | CCCAGAAATGCAGAGATTTC | 103 | 275 |
| 1125234 | N/A | N/A | 457 | 476 | AATCTACAAGGGAGAGAAGA | 51 | 276 |
| 1125262 | N/A | N/A | 603 | 622 | GGCACTAGACTAGACTGCCC | 33 | 277 |
| 1125290 | N/A | N/A | 690 | 709 | CTTAGACACAGCCCATACCC | 25 | 278 |
| 1125318 | N/A | N/A | 859 | 878 | ATTGAAGGCCCTGGCCTCTG | 37 | 279 |
| 1125346 | N/A | N/A | 957 | 976 | TCAAATCCCTCGCCCAGAGT | 56 | 280 |
| 1125374 | N/A | N/A | 1064 | 1083 | CAGGTGATGGGCTGAATACC | 123 | 281 |
| 1125402 | N/A | N/A | 1197 | 1216 | AATTTAGTGTCTGGAAGAAT | 44 | 282 |
| 1125430 | N/A | N/A | 1575 | 1594 | CCCCACCAAGTCAGGCCCAC | 66 | 283 |
| 1125458 | N/A | N/A | 1747 | 1766 | TGGACGGACAGAGAGGAGGG | 127 | 284 |
| 1125486 | N/A | N/A | 2123 | 2142 | AGGACCAAACCAGAACTAGG | 119 | 285 |
| 1125514 | N/A | N/A | 2253 | 2272 | TGTCTTCTTCAGAGGAATTG | 47 | 286 |
| 1125542 | N/A | N/A | 2341 | 2360 | GGCTCACAGGAACCTAATAC | 36 | 287 |
| 1125570 | N/A | N/A | 2479 | 2498 | GATTCAGGTGTGTGCTATAG | 13 | 288 |
| 1125598 | N/A | N/A | 2609 | 2628 | GTTTTTCACACTTTGTGCTT | 31 | 289 |
| 1125626 | N/A | N/A | 2734 | 2753 | GGGCATGCACAGAGCAGTGA | 47 | 290 |
| 1125654 | N/A | N/A | 2832 | 2851 | CTCATTCTTCTCTGGTTCTA | 32 | 291 |
| 1125682 | N/A | N/A | 2939 | 2958 | TAGGCACTTAATAATACTTG | 51 | 292 |
| 1125710 | N/A | N/A | 3042 | 3061 | GGAGTCAGATAGCTGGAGTA | 163 | 293 |
| 1125738 | N/A | N/A | 3436 | 3455 | CTCAGGGTCTGGTCAGGAAA | 62 | 294 |

TABLE 4-continued

Reduction of FXII RNA by 5-10-5 MOE gapmers with full PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS40528 | SEQ ID NO |
|---|---|---|---|---|---|---|---|
| 1125766 | N/A | N/A | 3631 | 3650 | CAGGCCCCTGCTCCAACTCC | 107 | 295 |
| 1125794 | N/A | N/A | 3743 | 3762 | GAGACAAGGCTTCCCTGCTC | 38 | 296 |
| 1125822 | N/A | N/A | 3889 | 3908 | GATACCAGGAGAGTAATGAG | 103 | 297 |
| 1125850 | N/A | N/A | 4015 | 4034 | AAGCTTGGTTTACCCACCTG | 94 | 298 |
| 1125878 | N/A | N/A | 4122 | 4141 | GAGAGATGGACATGGTGGAA | 79 | 299 |
| 1125906 | N/A | N/A | 4310 | 4329 | CCAGCAACCTATTCTGTAGG | 47 | 300 |
| 1125934 | N/A | N/A | 4535 | 4554 | CTCCCTGGCCCGTTCCCAAC | 30 | 301 |
| 1125962 | N/A | N/A | 4632 | 4651 | AACGCAGTGAGCCACCCCTG | 61 | 302 |
| 1125990 | N/A | N/A | 4859 | 4878 | CTGGGCTCTCCTGCCTCCCT | 80 | 303 |
| 1126018 | N/A | N/A | 5383 | 5402 | TTCCCCCCCCCACTTCCTAA | 187 | 304 |
| 1126046 | N/A | N/A | 5751 | 5770 | GAGACGGAGGAGCCGCGGCC | 120 | 305 |
| 1126074 | N/A | N/A | 6158 | 6177 | AACCCGGGCGGAGAGGAGCG | 170 | 306 |
| 1126102 | N/A | N/A | 6373 | 6392 | GGCTTCTTCCGCCTAACCCA | 111 | 307 |
| 1126130 | N/A | N/A | 6481 | 6500 | TGAATCCCAGGCCCTGGGAT | 73 | 308 |
| 1126158 | N/A | N/A | 6621 | 6640 | GAGTCGCAGAACCTGGCTCC | 84 | 309 |
| 1126186 | N/A | N/A | 6712 | 6731 | ATTTCATAGGCAAGGAGGCT | 53 | 310 |
| 1126214 | N/A | N/A | 6839 | 6858 | CTTCACACCCCATCTGACAA | 82 | 311 |
| 1126242 | N/A | N/A | 7106 | 7125 | GAATCACCCTGGGTCGGAAA | 43† | 312 |

TABLE 5

Reduction of FXII RNA by 5-10-5 MOE gapmers with full PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS40528 | SEQ ID NO |
|---|---|---|---|---|---|---|---|
| 413643 | 1839 | 1858 | 7227 | 7246 | GGCCACATCGGTGTAGACGC | 14 | 86 |
| 462073 | 216 | 235 | 3567 | 3586 | GGTACATTTGTGGTACAGCT | 36 | 183 |
| 626671 | 840 | 859 | N/A | N/A | GTCCGGGTTCCGGCAGAAGG | 19 | 313 |
| 1124164 | 33 | 52 | 33 | 52 | CATGGCATCCGTCCGTTGGT | 24 | 314 |
| 1124192 | 79 | 98 | 79 | 98 | TTGACTCCAAGCTCACCAGC | 95 | 315 |
| 1124220 | 136 | 155 | 503 | 522 | GCTCTTCAGCTTTGTACTTA | 93 | 316 |
| 1124246 | 172 | 191 | 3523 | 3542 | GGCAGGGCTCCCCGGTGACA | 36 | 317 |
| 1124269 | 226 | 245 | 3577 | 3596 | GGCCCTTGTGGGTACATTTG | 34 | 318 |
| 1124297 | 292 | 311 | 3799 | 3818 | AGTATCCCCATCGCTGGTCC | 24 | 319 |
| 1124325 | 332 | 351 | N/A | N/A | TGTTTGCTGCAGTGGTCTTT | 92 | 320 |

TABLE 5-continued

Reduction of FXII RNA by 5-10-5 MOE gapmers with full PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS40528 | SEQ ID NO |
|---|---|---|---|---|---|---|---|
| 1124353 | 405 | 424 | 4213 | 4232 | GAGGTGTTGTGGACAGAGAC | 24 | 321 |
| 1124381 | 447 | 466 | 4392 | 4411 | CTGAGGCTCAAAGCACTTCT | 27 | 322 |
| 1124408 | 493 | 512 | 4438 | 4457 | GCTCAGTTCTATACCATATC | 18 | 323 |
| 1124436 | 533 | 552 | 4478 | 4497 | GCATCAGGACCCTTGCACTG | 78 | 324 |
| 1124463 | 568 | 587 | N/A | N/A | TGCGGCAGGCCTGGCTGGCC | 65 | 325 |
| 1124490 | 607 | 626 | 4691 | 4710 | CCACCTCTAGGCAGCGACCC | 17 | 326 |
| 1124518 | 654 | 673 | 4738 | 4757 | GAAGGCTCCGGTGTAGCCCA | 75 | 327 |
| 1124546 | 710 | 729 | 4939 | 4958 | CCGCGGTAGCTGAGCCCGCG | 170 | 328 |
| 1124573 | 763 | 782 | 4992 | 5011 | CCTCCGAGGCCCACGGCTGA | 27 | 329 |
| 1124621 | 903 | 922 | 5217 | 5236 | GTCGCAGTACTCCCAGCTCA | 23 | 330 |
| 1124649 | 994 | 1013 | 5308 | 5327 | GTGCCGGCTGCGCGGGCATG | 42 | 331 |
| 1124677 | 1072 | 1091 | 5491 | 5510 | GCTGCTCCCGCTTCGCCGGC | 23 | 332 |
| 1124705 | 1117 | 1136 | 5536 | 5555 | GCCGCTGCCCGCAGCTCAGT | 40 | 333 |
| 1124731 | 1153 | 1172 | 5572 | 5591 | CAACGACGCGGGTCATCGAA | 64 | 334 |
| 1124758 | 1225 | 1244 | 5644 | 5663 | CGGCGCAGAAACTGTGGCCC | 35 | 335 |
| 1124785 | 1312 | 1331 | 5972 | 5991 | CGAGCACCACCGTCAGATCC | 30 | 336 |
| 1124813 | 1381 | 1400 | 6041 | 6060 | CGTGCAAGCGGTAGGAGCGC | 18 | 337 |
| 1124840 | 1460 | 1479 | 6203 | 6222 | AGCGCGCAGCTGCCGTCCGC | 59 | 338 |
| 1124864 | 1549 | 1568 | 6292 | 6311 | GGCCCCAGCCGGCCACCTGG | 54 | 339 |
| 1124891 | 1579 | 1598 | N/A | N/A | TGGCATATTCCTCCGCCCCC | 34 | 340 |
| 1124918 | 1621 | 1640 | 6919 | 6938 | GCTCCAGGGAGAGGAACGGT | 84 | 341 |
| 1124944 | 1747 | 1766 | 7135 | 7154 | CTTGGTCCTCACACACCAGC | 7† | 342 |
| 1124971 | 1794 | 1813 | 7182 | 7201 | CGATCCCCAGCTGATGATGC | 66 | 343 |
| 1125022 | 1871 | 1890 | 7259 | 7278 | ACGGTGTGCTCCCGGATCCA | 26 | 344 |
| 1125048 | 1916 | 1935 | 7304 | 7323 | CGGAATCACCAAGGAGGGAA | 35 | 345 |
| 1125075 | 1951 | 1970 | 7339 | 7358 | ATCTTGCCTTCCATGCCCCA | 23 | 346 |
| 1125101 | 2006 | 2025 | 7394 | 7413 | TGAGTTCCTGCGCCATCCTG | 7 | 347 |
| 1125123 | N/A | N/A | 97 | 116 | CAGCACTCACCGAAAGTGTT | 67 | 348 |
| 1125151 | N/A | N/A | 181 | 200 | GACCCACAGGTCATGAGCAG | 50 | 349 |
| 1125179 | N/A | N/A | 277 | 296 | CTGTGCCCTTGTATCCACCC | 67 | 350 |
| 1125207 | N/A | N/A | 371 | 390 | CAGCCCAGAAATGCAGAGAT | 45 | 351 |
| 1125235 | N/A | N/A | 460 | 479 | TGGAATCTACAAGGGAGAGA | 125 | 352 |
| 1125263 | N/A | N/A | 606 | 625 | GTAGGCACTAGACTAGACTG | 129 | 353 |
| 1125291 | N/A | N/A | 693 | 712 | GCACTTAGACACAGCCCATA | 69 | 354 |
| 1125319 | N/A | N/A | 862 | 881 | CCCATTGAAGGCCCTGGCCT | 38 | 355 |

TABLE 5-continued

Reduction of FXII RNA by 5-10-5 MOE gapmers with full PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS40528 | SEQ ID NO |
|---|---|---|---|---|---|---|---|
| 1125347 | N/A | N/A | 960 | 979 | AACTCAAATCCCTCGCCCAG | 77 | 356 |
| 1125375 | N/A | N/A | 1067 | 1086 | CACCAGGTGATGGGCTGAAT | 86 | 357 |
| 1125403 | N/A | N/A | 1200 | 1219 | GGTAATTTAGTGTCTGGAAG | 130 | 358 |
| 1125431 | N/A | N/A | 1578 | 1597 | CAACCCCACCAAGTCAGGCC | 74 | 359 |
| 1125459 | N/A | N/A | 1750 | 1769 | GGATGGACGGACAGAGAGGA | 60 | 360 |
| 1125487 | N/A | N/A | 2126 | 2145 | CCAAGGACCAAACCAGAACT | 84 | 361 |
| 1125515 | N/A | N/A | 2256 | 2275 | CTGTGTCTTCTTCAGAGGAA | 50 | 362 |
| 1125543 | N/A | N/A | 2370 | 2389 | TGTTGGTTGATGAAAATGTT | 55 | 363 |
| 1125571 | N/A | N/A | 2482 | 2501 | CTTGATTCAGGTGTGTGCTA | 73 | 364 |
| 1125599 | N/A | N/A | 2628 | 2647 | TCAGTCTACTTAGTGCAACG | 98 | 365 |
| 1125627 | N/A | N/A | 2739 | 2758 | TTTGTGGGCATGCACAGAGC | 31 | 366 |
| 1125655 | N/A | N/A | 2835 | 2854 | ATCCTCATTCTTCTCTGGTT | 26 | 367 |
| 1125683 | N/A | N/A | 2942 | 2961 | AAGTAGGCACTTAATAATAC | 73 | 368 |
| 1125711 | N/A | N/A | 3045 | 3064 | TCAGGAGTCAGATAGCTGGA | 100 | 369 |
| 1125739 | N/A | N/A | 3439 | 3458 | TCCCTCAGGGTCTGGTCAGG | 25 | 370 |
| 1125767 | N/A | N/A | 3637 | 3656 | GTCTCCCAGGCCCCTGCTCC | 77 | 371 |
| 1125795 | N/A | N/A | 3749 | 3768 | TAGAAAGAGACAAGGCTTCC | 102 | 372 |
| 1125823 | N/A | N/A | 3892 | 3911 | GGTGATACCAGGAGAGTAAT | 93 | 373 |
| 1125851 | N/A | N/A | 4018 | 4037 | TCCAAGCTTGGTTTACCCAC | 38 | 374 |
| 1125879 | N/A | N/A | 4125 | 4144 | TCTGAGAGATGGACATGGTG | 69 | 375 |
| 1125907 | N/A | N/A | 4313 | 4332 | TATCCAGCAACCTATTCTGT | 152 | 376 |
| 1125935 | N/A | N/A | 4538 | 4557 | CTCCTCCCTGGCCCGTTCCC | 64 | 377 |
| 1125963 | N/A | N/A | 4635 | 4654 | GGGAACGCAGTGAGCCACCC | 97 | 378 |
| 1125991 | N/A | N/A | 4862 | 4881 | AGGCTGGGCTCTCCTGCCTC | 105 | 379 |
| 1126019 | N/A | N/A | 5386 | 5405 | TCCTTCCCCCCCCCACTTCC | 37 | 380 |
| 1126047 | N/A | N/A | 5754 | 5773 | TGGGAGACGGAGGAGCCGCG | 87 | 381 |
| 1126075 | N/A | N/A | 6161 | 6180 | GCTAACCCGGGCGGAGAGGA | 36 | 382 |
| 1126103 | N/A | N/A | 6376 | 6395 | GCGGGCTTCTTCCGCCTAAC | 66 | 383 |
| 1126131 | N/A | N/A | 6484 | 6503 | CAGTGAATCCCAGGCCCTGG | 34 | 384 |
| 1126159 | N/A | N/A | 6624 | 6643 | CCAGAGTCGCAGAACCTGGC | 34 | 385 |
| 1126187 | N/A | N/A | 6715 | 6734 | TCAATTTCATAGGCAAGGAG | 28 | 386 |
| 1126215 | N/A | N/A | 6842 | 6861 | CTTCTTCACACCCCATCTGA | 100 | 387 |
| 1126243 | N/A | N/A | 7109 | 7128 | CCGGAATCACCCTGGGTCGG | 28† | 388 |

TABLE 6

Reduction of FXII RNA by 5-10-5 MOE gapmers with full PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS40528 | SEQ ID NO |
|---|---|---|---|---|---|---|---|
| 413637 | 1748 | 1767 | 7136 | 7155 | GCTTGGTCCTCACACACCAG | 12† | 80 |
| 462073 | 216 | 235 | 3567 | 3586 | GGTACATTTGTGGTACAGCT | 20 | 183 |
| 1124193 | 80 | 99 | 80 | 99 | GTTGACTCCAAGCTCACCAG | 34 | 389 |
| 1124221 | 138 | 157 | 505 | 524 | GTGCTCTTCAGCTTTGTACT | 37 | 390 |
| 1124247 | 174 | 193 | 3525 | 3544 | GTGGCAGGGCTCCCCGGTGA | 54 | 391 |
| 1124270 | 228 | 247 | 3579 | 3598 | CCGGCCCTTGTGGGTACATT | 51 | 392 |
| 1124298 | 293 | 312 | 3800 | 3819 | CAGTATCCCCATCGCTGGTC | 36 | 393 |
| 1124326 | 333 | 352 | N/A | N/A | GTGTTTGCTGCAGTGGTCTT | 56 | 394 |
| 1124354 | 406 | 425 | 4214 | 4233 | TGAGGTGTTGTGGACAGAGA | 56 | 395 |
| 1124382 | 449 | 468 | 4394 | 4413 | AGCTGAGGCTCAAAGCACTT | 38 | 396 |
| 1124409 | 494 | 513 | 4439 | 4458 | TGCTCAGTTCTATACCATAT | 31 | 397 |
| 1124437 | 535 | 554 | 4480 | 4499 | GGGCATCAGGACCCTTGCAC | 66 | 398 |
| 1124464 | 569 | 588 | N/A | N/A | GTGCGGCAGGCCTGGCTGGC | 70 | 399 |
| 1124491 | 609 | 628 | 4693 | 4712 | CTCCACCTCTAGGCAGCGAC | 28 | 400 |
| 1124519 | 655 | 674 | 4739 | 4758 | AGAAGGCTCCGGTGTAGCCC | 102 | 401 |
| 1124547 | 711 | 730 | 4940 | 4959 | GCCGCGGTAGCTGAGCCCGC | 58 | 402 |
| 1124574 | 765 | 784 | 4994 | 5013 | GGCCTCCGAGGCCCACGGCT | 44 | 403 |
| 1124597 | 843 | 862 | N/A | N/A | GTTGTCCGGGTTCCGGCAGA | 45 | 404 |
| 1124622 | 904 | 923 | 5218 | 5237 | GGTCGCAGTACTCCCAGCTC | 42 | 405 |
| 1124650 | 996 | 1015 | 5310 | 5329 | CGGTGCCGGCTGCGCGGGCA | 90 | 406 |
| 1124678 | 1073 | 1092 | 5492 | 5511 | GGCTGCTCCCGCTTCGCCGG | 92 | 407 |
| 1124706 | 1118 | 1137 | 5537 | 5556 | AGCCGCTGCCCGCAGCTCAG | 39 | 408 |
| 1124732 | 1155 | 1174 | 5574 | 5593 | GCCAACGACGCGGGTCATCG | 38 | 409 |
| 1124759 | 1227 | 1246 | 5646 | 5665 | GCCGGCGCAGAAACTGTGGC | 55 | 410 |
| 1124786 | 1313 | 1332 | 5973 | 5992 | CCGAGCACCACCGTCAGATC | 40 | 411 |
| 1124814 | 1399 | 1418 | 6059 | 6078 | TGACGGGCGAGAAGGCCTCG | 59 | 412 |
| 1124841 | 1462 | 1481 | 6205 | 6224 | GGAGCGCGCAGCTGCCGTCC | 44 | 413 |
| 1124865 | 1550 | 1569 | 6293 | 6312 | TGGCCCCAGCCGGCCACCTG | 53 | 414 |
| 1124892 | 1581 | 1600 | 6879 | 6898 | GCTGGCATATTCCTCCGCCC | 78 | 415 |
| 1124919 | 1622 | 1641 | 6920 | 6939 | CGCTCCAGGGAGAGGAACGG | 80 | 416 |
| 1124972 | 1795 | 1814 | 7183 | 7202 | CCGATCCCCAGCTGATGATG | 41 | 417 |
| 1124997 | 1842 | 1861 | 7230 | 7249 | GTAGGCCACATCGGTGTAGA | 39 | 418 |
| 1125023 | 1873 | 1892 | 7261 | 7280 | AAACGGTGTGCTCCCGGATC | 26 | 419 |
| 1125049 | 1917 | 1936 | 7305 | 7324 | GCGGAATCACCAAGGAGGGA | 20 | 420 |
| 1125076 | 1952 | 1971 | 7340 | 7359 | AATCTTGCCTTCCATGCCCC | 22 | 421 |

TABLE 6-continued

Reduction of FXII RNA by 5-10-5 MOE gapmers with full PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS40528 | SEQ ID NO |
| --- | --- | --- | --- | --- | --- | --- | --- |
| 1125102 | 2007 | 2026 | 7395 | 7414 | TTGAGTTCCTGCGCCATCCT | 15 | 422 |
| 1125124 | N/A | N/A | 100 | 119 | CCACAGCACTCACCGAAAGT | 102 | 423 |
| 1125152 | N/A | N/A | 184 | 203 | CTGGACCCACAGGTCATGAG | 87 | 424 |
| 1125180 | N/A | N/A | 280 | 299 | AGGCTGTGCCCTTGTATCCA | 109 | 425 |
| 1125208 | N/A | N/A | 374 | 393 | TCACAGCCCAGAAATGCAGA | 82 | 426 |
| 1125236 | N/A | N/A | 463 | 482 | AGGTGGAATCTACAAGGGAG | 100 | 427 |
| 1125264 | N/A | N/A | 609 | 628 | CAGGTAGGCACTAGACTAGA | 81 | 428 |
| 1125292 | N/A | N/A | 696 | 715 | TGGGCACTTAGACACAGCCC | 52 | 429 |
| 1125320 | N/A | N/A | 865 | 884 | TTGCCCATTGAAGGCCCTGG | 39 | 430 |
| 1125348 | N/A | N/A | 963 | 982 | GAGAACTCAAATCCCTCGCC | 50 | 431 |
| 1125376 | N/A | N/A | 1070 | 1089 | ATGCACCAGGTGATGGGCTG | 62 | 432 |
| 1125404 | N/A | N/A | 1203 | 1222 | GTAGGTAATTTAGTGTCTGG | 59 | 433 |
| 1125432 | N/A | N/A | 1581 | 1600 | ACTCAACCCCACCAAGTCAG | 52 | 434 |
| 1125460 | N/A | N/A | 1753 | 1772 | ATGGGATGGACGGACAGAGA | 58 | 435 |
| 1125488 | N/A | N/A | 2129 | 2148 | TTGCCAAGGACCAAACCAGA | 72 | 436 |
| 1125516 | N/A | N/A | 2259 | 2278 | TGCCTGTGTCTTCTTCAGAG | 61 | 437 |
| 1125544 | N/A | N/A | 2373 | 2392 | TGCTGTTGGTTGATGAAAAT | 62 | 438 |
| 1125572 | N/A | N/A | 2485 | 2504 | ACACTTGATTCAGGTGTGTG | 74 | 439 |
| 1125600 | N/A | N/A | 2634 | 2653 | TCCTTCTCAGTCTACTTAGT | 49 | 440 |
| 1125628 | N/A | N/A | 2742 | 2761 | CCATTTGTGGGCATGCACAG | 75 | 441 |
| 1125656 | N/A | N/A | 2838 | 2857 | TTGATCCTCATTCTTCTCTG | 77 | 442 |
| 1125684 | N/A | N/A | 2950 | 2969 | TTGCCACAAAGTAGGCACTT | 51 | 443 |
| 1125712 | N/A | N/A | 3048 | 3067 | GGTTCAGGAGTCAGATAGCT | 66 | 444 |
| 1125740 | N/A | N/A | 3442 | 3461 | CTGTCCCTCAGGGTCTGGTC | 61 | 445 |
| 1125768 | N/A | N/A | 3640 | 3659 | CATGTCTCCCAGGCCCTGC | 73 | 446 |
| 1125796 | N/A | N/A | 3752 | 3771 | CTGTAGAAAGAGACAAGGCT | 59 | 447 |
| 1125824 | N/A | N/A | 3895 | 3914 | TCTGGTGATACCAGGAGAGT | 48 | 448 |
| 1125852 | N/A | N/A | 4021 | 4040 | GTTTCCAAGCTTGGTTTACC | 54 | 449 |
| 1125880 | N/A | N/A | 4128 | 4147 | TGGTCTGAGAGATGGACATG | 59 | 450 |
| 1125908 | N/A | N/A | 4316 | 4335 | GAGTATCCAGCAACCTATTC | 67 | 451 |
| 1125936 | N/A | N/A | 4541 | 4560 | ACGCTCCTCCCTGGCCCGTT | 60 | 452 |
| 1125964 | N/A | N/A | 4638 | 4657 | GGAGGGAACGCAGTGAGCCA | 127 | 453 |
| 1125992 | N/A | N/A | 4866 | 4885 | GCCAAGGCTGGGCTCTCCTG | 57 | 454 |
| 1126020 | N/A | N/A | 5389 | 5408 | TCCTCCTTCCCCCCCCCACT | 82 | 455 |
| 1126048 | N/A | N/A | 5757 | 5776 | CGCTGGGAGACGGAGGAGCC | 116 | 456 |

TABLE 6-continued

Reduction of FXII RNA by 5-10-5 MOE gapmers with full PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS40528 | SEQ ID NO |
|---|---|---|---|---|---|---|---|
| 1126076 | N/A | N/A | 6164 | 6183 | AGAGCTAACCCGGGCGGAGA | 120 | 457 |
| 1126104 | N/A | N/A | 6379 | 6398 | GTCGCGGGCTTCTTCCGCCT | 54 | 458 |
| 1126132 | N/A | N/A | 6487 | 6506 | CAGCAGTGAATCCCAGGCCC | 96 | 459 |
| 1126160 | N/A | N/A | 6627 | 6646 | CATCCAGAGTCGCAGAACCT | 105 | 460 |
| 1126188 | N/A | N/A | 6718 | 6737 | AATTCAATTTCATAGGCAAG | 73 | 461 |
| 1126216 | N/A | N/A | 6845 | 6864 | CGCCTTCTTCACACCCCATC | 68 | 462 |
| 1126244 | N/A | N/A | 7112 | 7131 | CCTCCGGAATCACCCTGGGT | 31† | 463 |

TABLE 7

Reduction of FXII RNA by 5-10-5 MOE gapmers with full PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS40528 | SEQ ID NO |
|---|---|---|---|---|---|---|---|
| 462073 | 216 | 235 | 3567 | 3586 | GGTACATTTGTGGTACAGCT | 15 | 183 |
| 564842 | 1463 | 1482 | 6206 | 6225 | AGGAGCGCGCAGCTGCCGTC | 44 | 464 |
| 1124194 | 82 | 101 | 82 | 101 | GTGTTGACTCCAAGCTCACC | 63 | 465 |
| 1124222 | 139 | 158 | 506 | 525 | TGTGCTCTTCAGCTTTGTAC | 25 | 466 |
| 1124248 | 175 | 194 | 3526 | 3545 | AGTGGCAGGGCTCCCCGGTG | 48 | 467 |
| 1124271 | 229 | 248 | 3580 | 3599 | GCCGGCCCTTGTGGGTACAT | 49 | 468 |
| 1124299 | 294 | 313 | 3801 | 3820 | ACAGTATCCCCATCGCTGGT | 46 | 469 |
| 1124327 | 334 | 353 | 4142 | 4161 | TGTGTTTGCTGCAGTGGTCT | 52 | 470 |
| 1124355 | 407 | 426 | 4215 | 4234 | GTGAGGTGTTGTGGACAGAG | 110 | 471 |
| 1124383 | 450 | 469 | 4395 | 4414 | AAGCTGAGGCTCAAAGCACT | 55 | 472 |
| 1124410 | 495 | 514 | 4440 | 4459 | TTGCTCAGTTCTATACCATA | 36 | 473 |
| 1124438 | 536 | 555 | 4481 | 4500 | TGGGCATCAGGACCCTTGCA | 51 | 474 |
| 1124465 | 570 | 589 | N/A | N/A | GGTGCGGCAGGCCTGGCTGG | 140 | 475 |
| 1124492 | 610 | 629 | 4694 | 4713 | CCTCCACCTCTAGGCAGCGA | 38 | 476 |
| 1124520 | 656 | 675 | 4740 | 4759 | CAGAAGGCTCCGGTGTAGCC | 63 | 477 |
| 1124548 | 712 | 731 | 4941 | 4960 | GGCCGCGGTAGCTGAGCCCG | 66 | 478 |
| 1124575 | 766 | 785 | 4995 | 5014 | TGGCCTCCGAGGCCCACGGC | 65 | 479 |
| 1124598 | 844 | 863 | N/A | N/A | CGTTGTCCGGGTTCCGGCAG | 33 | 480 |
| 1124623 | 905 | 924 | 5219 | 5238 | AGGTCGCAGTACTCCCAGCT | 47 | 481 |
| 1124651 | 997 | 1016 | 5311 | 5330 | GCGGTGCCGGCTGCGCGGGC | 57 | 482 |
| 1124679 | 1075 | 1094 | 5494 | 5513 | GCGGCTGCTCCCGCTTCGCC | 45 | 483 |

TABLE 7-continued

Reduction of FXII RNA by 5-10-5 MOE gapmers with full PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS40528 | SEQ ID NO |
|---|---|---|---|---|---|---|---|
| 1124707 | 1120 | 1139 | 5539 | 5558 | GGAGCCGCTGCCCGCAGCTC | 47 | 484 |
| 1124733 | 1156 | 1175 | 5575 | 5594 | CGCCAACGACGCGGGTCATC | 42 | 485 |
| 1124760 | 1228 | 1247 | 5647 | 5666 | TGCCGGCGCAGAAACTGTGG | 64 | 486 |
| 1124787 | 1314 | 1333 | 5974 | 5993 | GCCGAGCACCACCGTCAGAT | 36 | 487 |
| 1124815 | 1400 | 1419 | 6060 | 6079 | CTGACGGGCGAGAAGGCCTC | 45 | 488 |
| 1124866 | 1551 | 1570 | 6294 | 6313 | GTGGCCCCAGCCGGCCACCT | 118 | 489 |
| 1124893 | 1582 | 1601 | 6880 | 6899 | AGCTGGCATATTCCTCCGCC | 81 | 490 |
| 1124920 | 1623 | 1642 | 6921 | 6940 | GCGCTCCAGGGAGAGGAACG | 79 | 491 |
| 1124945 | 1749 | 1768 | 7137 | 7156 | AGCTTGGTCCTCACACACCA | 121 | 492 |
| 1124973 | 1796 | 1815 | 7184 | 7203 | CCCGATCCCCAGCTGATGAT | 39 | 493 |
| 1124998 | 1843 | 1862 | 7231 | 7250 | AGTAGGCCACATCGGTGTAG | 31 | 494 |
| 1125024 | 1874 | 1893 | 7262 | 7281 | GAAACGGTGTGCTCCCGGAT | 34 | 495 |
| 1125050 | 1918 | 1937 | 7306 | 7325 | TGCGGAATCACCAAGGAGGG | 23 | 496 |
| 1125077 | 1954 | 1973 | 7342 | 7361 | ACAATCTTGCCTTCCATGCC | 23 | 497 |
| 1125103 | 2009 | 2028 | 7397 | 7416 | TATTGAGTTCCTGCGCCATC | 25 | 498 |
| 1125125 | N/A | N/A | 103 | 122 | TTCCCACAGCACTCACCGAA | 84 | 499 |
| 1125153 | N/A | N/A | 187 | 206 | CACCTGGACCCACAGGTCAT | 110 | 500 |
| 1125181 | N/A | N/A | 283 | 302 | TGCAGGCTGTGCCCTTGTAT | 78 | 501 |
| 1125209 | N/A | N/A | 377 | 396 | CTCTCACAGCCCAGAAATGC | 68 | 502 |
| 1125237 | N/A | N/A | 466 | 485 | CCAAGGTGGAATCTACAAGG | 78 | 503 |
| 1125265 | N/A | N/A | 612 | 631 | CACCAGGTAGGCACTAGACT | 64 | 504 |
| 1125293 | N/A | N/A | 716 | 735 | CCTGCTCCGAGCCAGGCTCG | 74 | 505 |
| 1125321 | N/A | N/A | 868 | 887 | TCCTTGCCCATTGAAGGCCC | 65 | 506 |
| 1125349 | N/A | N/A | 966 | 985 | TTGGAGAACTCAAATCCCTC | 66 | 507 |
| 1125377 | N/A | N/A | 1073 | 1092 | TCCATGCACCAGGTGATGGG | 58 | 508 |
| 1125405 | N/A | N/A | 1206 | 1225 | CATGTAGGTAATTTAGTGTC | 90 | 509 |
| 1125433 | N/A | N/A | 1584 | 1603 | GAGACTCAACCCCACCAAGT | 88 | 510 |
| 1125461 | N/A | N/A | 1756 | 1775 | CAGATGGGATGGACGGACAG | 65 | 511 |
| 1125489 | N/A | N/A | 2132 | 2151 | CACTTGCCAAGGACCAAACC | 86 | 512 |
| 1125517 | N/A | N/A | 2262 | 2281 | AATTGCCTGTGTCTTCTTCA | 57 | 513 |
| 1125545 | N/A | N/A | 2376 | 2395 | ATATGCTGTTGGTTGATGAA | 55 | 514 |
| 1125573 | N/A | N/A | 2488 | 2507 | TAGACACTTGATTCAGGTGT | 57 | 515 |
| 1125601 | N/A | N/A | 2637 | 2656 | GTGTCCTTCTCAGTCTACTT | 68 | 516 |
| 1125629 | N/A | N/A | 2745 | 2764 | TGGCCATTTGTGGGCATGCA | 54 | 517 |
| 1125657 | N/A | N/A | 2841 | 2860 | CAGTTGATCCTCATTCTTCT | 59 | 518 |

TABLE 7-continued

Reduction of FXII RNA by 5-10-5 MOE gapmers with full PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS40528 | SEQ ID NO |
|---|---|---|---|---|---|---|---|
| 1125685 | N/A | N/A | 2953 | 2972 | CACTTGCCACAAAGTAGGCA | 51 | 519 |
| 1125713 | N/A | N/A | 3051 | 3070 | TTGGGTTCAGGAGTCAGATA | 116 | 520 |
| 1125741 | N/A | N/A | 3445 | 3464 | GCACTGTCCCTCAGGGTCTG | 68 | 521 |
| 1125769 | N/A | N/A | 3643 | 3662 | GTACATGTCTCCCAGGCCCC | 57 | 522 |
| 1125797 | N/A | N/A | 3755 | 3774 | CACCTGTAGAAAGAGACAAG | 148 | 523 |
| 1125825 | N/A | N/A | 3898 | 3917 | GGGTCTGGTGATACCAGGAG | 56 | 524 |
| 1125853 | N/A | N/A | 4024 | 4043 | CAAGTTTCCAAGCTTGGTTT | 53 | 525 |
| 1125881 | N/A | N/A | 4131 | 4150 | CAGTGGTCTGAGAGATGGAC | 56 | 526 |
| 1125909 | N/A | N/A | 4319 | 4338 | TCCGAGTATCCAGCAACCTA | 88 | 527 |
| 1125937 | N/A | N/A | 4557 | 4576 | CCAGCCTGTCTTCCTGACGC | 63 | 528 |
| 1125965 | N/A | N/A | 4657 | 4676 | GTTGGTGCGGCAGGCTTGGG | 60 | 529 |
| 1125993 | N/A | N/A | 4869 | 4888 | GCAGCCAAGGCTGGGCTCTC | 75 | 530 |
| 1126021 | N/A | N/A | 5392 | 5411 | GGCTCCTCCTTCCCCCCCCC | 54 | 531 |
| 1126049 | N/A | N/A | 5760 | 5779 | CTGCGCTGGGAGACGGAGGA | 181 | 532 |
| 1126077 | N/A | N/A | 6167 | 6186 | AACAGAGCTAACCCGGGCGG | 67 | 533 |
| 1126105 | N/A | N/A | 6382 | 6401 | AAAGTCGCGGGCTTCTTCCG | 59 | 534 |
| 1126133 | N/A | N/A | 6490 | 6509 | TCCCAGCAGTGAATCCCAGG | 88 | 535 |
| 1126161 | N/A | N/A | 6630 | 6649 | ACCCATCCAGAGTCGCAGAA | 72 | 536 |
| 1126189 | N/A | N/A | 6721 | 6740 | ATTAATTCAATTTCATAGGC | 76 | 537 |
| 1126217 | N/A | N/A | 6862 | 6881 | CCCCTGCGAACACAGAGCGC | 105 | 538 |

TABLE 8

Reduction of FXII RNA by 5-10-5 MOE gapmers with full PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS40528 | SEQ ID NO |
|---|---|---|---|---|---|---|---|
| 413644 | 1844 | 1863 | 7232 | 7251 | TAGTAGGCCACATCGGTGTA | 32 | 87 |
| 462073 | 216 | 235 | 3567 | 3586 | GGTACATTTGTGGTACAGCT | 48 | 183 |
| 564822 | 862 | 881 | 5176 | 5195 | AGCACCACGGGCGGATGTCG | 69 | 539 |
| 1124167 | 36 | 55 | 36 | 55 | CCTCATGGCATCCGTCCGTT | 42 | 540 |
| 1124195 | 83 | 102 | 83 | 102 | AGTGTTGACTCCAAGCTCAC | 45 | 541 |
| 1124223 | 141 | 160 | 508 | 527 | TGTGTGCTCTTCAGCTTTGT | 32 | 542 |
| 1124249 | 177 | 196 | 3528 | 3547 | GAAGTGGCAGGGCTCCCCGG | 54 | 543 |

TABLE 8-continued

Reduction of FXII RNA by 5-10-5 MOE gapmers with full PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS40528 | SEQ ID NO |
|---|---|---|---|---|---|---|---|
| 1124272 | 231 | 250 | 3582 | 3601 | TGGCCGGCCCTTGTGGGTAC | 141 | 544 |
| 1124300 | 296 | 315 | 3803 | 3822 | AAACAGTATCCCCATCGCTG | 66 | 545 |
| 1124328 | 335 | 354 | 4143 | 4162 | CTGTGTTTGCTGCAGTGGTC | 38 | 546 |
| 1124356 | 408 | 427 | 4216 | 4235 | AGTGAGGTGTTGTGGACAGA | 73 | 547 |
| 1124384 | 451 | 470 | 4396 | 4415 | GAAGCTGAGGCTCAAAGCAC | 32 | 548 |
| 1124411 | 496 | 515 | 4441 | 4460 | CTTGCTCAGTTCTATACCAT | 52 | 549 |
| 1124439 | 537 | 556 | 4482 | 4501 | GTGGGCATCAGGACCCTTGC | 45 | 550 |
| 1124466 | 571 | 590 | N/A | N/A | TGGTGCGGCAGGCCTGGCTG | 146 | 551 |
| 1124493 | 612 | 631 | 4696 | 4715 | GCCCTCCACCTCTAGGCAGC | 70 | 552 |
| 1124521 | 657 | 676 | 4741 | 4760 | GCAGAAGGCTCCGGTGTAGC | 97 | 553 |
| 1124549 | 714 | 733 | 4943 | 4962 | CAGGCCGCGGTAGCTGAGCC | 99 | 554 |
| 1124576 | 767 | 786 | 4996 | 5015 | GTGGCCTCCGAGGCCCACGG | 78 | 555 |
| 1124624 | 907 | 926 | 5221 | 5240 | CCAGGTCGCAGTACTCCCAG | 51 | 556 |
| 1124652 | 998 | 1017 | 5312 | 5331 | GGCGGTGCCGGCTGCGCGGG | 70 | 557 |
| 1124680 | 1076 | 1095 | 5495 | 5514 | GGCGGCTGCTCCCGCTTCGC | 67 | 558 |
| 1124708 | 1121 | 1140 | 5540 | 5559 | CGGAGCCGCTGCCCGCAGCT | 136 | 559 |
| 1124734 | 1158 | 1177 | 5577 | 5596 | CCCGCCAACGACGCGGGTCA | 51 | 560 |
| 1124761 | 1229 | 1248 | 5648 | 5667 | CTGCCGGCGCAGAAACTGTG | 54 | 561 |
| 1124788 | 1315 | 1334 | 5975 | 5994 | GGCCGAGCACCACCGTCAGA | 100 | 562 |
| 1124816 | 1401 | 1420 | 6061 | 6080 | GCTGACGGGCGAGAAGGCCT | 70 | 563 |
| 1124842 | 1464 | 1483 | 6207 | 6226 | CAGGAGCGCGCAGCTGCCGT | 40 | 564 |
| 1124867 | 1552 | 1571 | 6295 | 6314 | GGTGGCCCCAGCCGGCCACC | 66 | 565 |
| 1124894 | 1583 | 1602 | 6881 | 6900 | AAGCTGGCATATTCCTCCGC | 80 | 566 |
| 1124921 | 1657 | 1676 | 6955 | 6974 | GGATGGAGGATCCGTGCACG | 30† | 567 |
| 1124946 | 1750 | 1769 | 7138 | 7157 | CAGCTTGGTCCTCACACACC | 18† | 568 |
| 1124974 | 1797 | 1816 | 7185 | 7204 | GCCCGATCCCCAGCTGATGA | 43 | 569 |
| 1125025 | 1876 | 1895 | 7264 | 7283 | AGGAAACGGTGTGCTCCCGG | 42 | 570 |
| 1125051 | 1919 | 1938 | 7307 | 7326 | CTGCGGAATCACCAAGGAGG | 26 | 571 |
| 1125078 | 1955 | 1974 | 7343 | 7362 | CACAATCTTGCCTTCCATGC | 37 | 572 |
| 1125104 | 2010 | 2029 | 7398 | 7417 | TTATTGAGTTCCTGCGCCAT | 22 | 573 |
| 1125126 | N/A | N/A | 106 | 125 | TGGTTCCCACAGCACTCACC | 73 | 574 |
| 1125154 | N/A | N/A | 190 | 209 | AGTCACCTGGACCCACAGGT | 78 | 575 |
| 1125182 | N/A | N/A | 286 | 305 | AAATGCAGGCTGTGCCCTTG | 69 | 576 |
| 1125210 | N/A | N/A | 380 | 399 | TTCCTCTCACAGCCCAGAAA | 60 | 577 |
| 1125238 | N/A | N/A | 469 | 488 | TTCCCAAGGTGGAATCTACA | 84 | 578 |

TABLE 8-continued

Reduction of FXII RNA by 5-10-5 MOE gapmers with full PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) RTS40528 | SEQ ID NO |
|---|---|---|---|---|---|---|---|
| 1125266 | N/A | N/A | 615 | 634 | TAGCACCAGGTAGGCACTAG | 66 | 579 |
| 1125294 | N/A | N/A | 721 | 740 | AAGCACCTGCTCCGAGCCAG | 56 | 580 |
| 1125322 | N/A | N/A | 871 | 890 | CCTTCCTTGCCCATTGAAGG | 60 | 581 |
| 1125350 | N/A | N/A | 969 | 988 | AGCTTGGAGAACTCAAATCC | 62 | 582 |
| 1125378 | N/A | N/A | 1076 | 1095 | ATTTCCATGCACCAGGTGAT | 62 | 583 |
| 1125406 | N/A | N/A | 1209 | 1228 | TGGCATGTAGGTAATTTAGT | 63 | 584 |
| 1125434 | N/A | N/A | 1587 | 1606 | TTAGAGACTCAACCCCACCA | 143 | 585 |
| 1125462 | N/A | N/A | 1759 | 1778 | ATGCAGATGGGATGGACGGA | 167 | 586 |
| 1125490 | N/A | N/A | 2135 | 2154 | GTGCACTTGCCAAGGACCAA | 73 | 587 |
| 1125518 | N/A | N/A | 2265 | 2284 | GAGAATTGCCTGTGTCTTCT | 55 | 588 |
| 1125546 | N/A | N/A | 2379 | 2398 | ATTATATGCTGTTGGTTGAT | 123 | 589 |
| 1125574 | N/A | N/A | 2513 | 2532 | GCTACCTTAGGGAGAAAGCG | 121 | 590 |
| 1125602 | N/A | N/A | 2640 | 2659 | TGAGTGTCCTTCTCAGTCTA | 69 | 591 |
| 1125630 | N/A | N/A | 2748 | 2767 | TCATGGCCATTTGTGGGCAT | 89 | 592 |
| 1125658 | N/A | N/A | 2845 | 2864 | AGTACAGTTGATCCTCATTC | 162 | 593 |
| 1125686 | N/A | N/A | 2956 | 2975 | GAGCACTTGCCACAAAGTAG | 91 | 594 |
| 1125714 | N/A | N/A | 3054 | 3073 | AACTTGGGTTCAGGAGTCAG | 105 | 595 |
| 1125742 | N/A | N/A | 3448 | 3467 | CAGGCACTGTCCCTCAGGGT | 141 | 596 |
| 1125770 | N/A | N/A | 3649 | 3668 | GGCAGGGTACATGTCTCCCA | 68 | 597 |
| 1125798 | N/A | N/A | 3758 | 3777 | GCACACCTGTAGAAAGAGAC | 82 | 598 |
| 1125826 | N/A | N/A | 3916 | 3935 | CAGAATCCCAGGTGTGTGGG | 54 | 599 |
| 1125854 | N/A | N/A | 4027 | 4046 | CTCCAAGTTTCCAAGCTTGG | 116 | 600 |
| 1125882 | N/A | N/A | 4134 | 4153 | CTGCAGTGGTCTGAGAGATG | 102 | 601 |
| 1125910 | N/A | N/A | 4325 | 4344 | CAAGTCTCCGAGTATCCAGC | 96 | 602 |
| 1125938 | N/A | N/A | 4560 | 4579 | CTGCCAGCCTGTCTTCCTGA | 80 | 603 |
| 1125966 | N/A | N/A | 4660 | 4679 | CGGGTTGGTGCGGCAGGCTT | 95 | 604 |
| 1125994 | N/A | N/A | 4875 | 4894 | CCCTGGGCAGCCAAGGCTGG | 67 | 605 |
| 1126022 | N/A | N/A | 5395 | 5414 | CTCGGCTCCTCCTTCCCCCC | 61 | 606 |
| 1126050 | N/A | N/A | 5763 | 5782 | AAGCTGCGCTGGGAGACGGA | 123 | 607 |
| 1126078 | N/A | N/A | 6170 | 6189 | CGCAACAGAGCTAACCCGGG | 76 | 608 |
| 1126106 | N/A | N/A | 6385 | 6404 | ACCAAAGTCGCGGGCTTCTT | 150 | 609 |
| 1126134 | N/A | N/A | 6493 | 6512 | GGATCCCAGCAGTGAATCCC | 70 | 610 |
| 1126162 | N/A | N/A | 6633 | 6652 | ACCACCCATCCAGAGTCGCA | 60 | 611 |
| 1126190 | N/A | N/A | 6724 | 6743 | GCCATTAATTCAATTTCATA | 72 | 612 |
| 1126218 | N/A | N/A | 6865 | 6884 | CCGCCCCTGCGAACACAGAG | 66 | 613 |

TABLE 9

Reduction of FXII RNA by 5-10-5 MOE gapmers with full PS internucleoside linkages (Huh7, oligofectamine, 200 nM modified oligonucleotide)

| Compound Number | SEQ ID NO: 3 Start Site | SEQ ID NO: 3 Stop Site | SEQ ID NO: 4 Start Site | SEQ ID NO: 4 Stop Site | Sequence (5' to 3') | FXII (% UTC) | SEQ ID NO |
|---|---|---|---|---|---|---|---|
| 462200 | 10845 | 10864 | N/A | N/A | CTTCTCAGCATTTTCAAAGC | 63 | 614 |
| 462201 | 10848 | 10867 | N/A | N/A | TTCCTTCTCAGCATTTTCAA | 63 | 615 |

TABLE 10

Reduction of FXII RNA by 5-10-5 MOE gapmers with full PS internucleoside linkages (Huh7, electroporation, 5000 nM modified oligonucleotide)

| Compound Number | SEQ ID NO: 3 Start Site | SEQ ID NO: 3 Stop Site | SEQ ID NO: 4 Start Site | SEQ ID NO: 4 Stop Site | Sequence (5' to 3') | FXII (% UTC) | SEQ ID NO |
|---|---|---|---|---|---|---|---|
| 1126246 | 10849 | 10868 | N/A | N/A | TTTCCTTCTCAGCATTTTCA | 130 | 616 |

TABLE 11

Reduction of FXII RNA by 5-10-5 MOE gapmers with full PS internucleoside linkages electroporation, 5000 nM modified oligonucleotide)

| Compound Number | SEQ ID NO: 3 Start Site | SEQ ID NO: 3 Stop Site | SEQ ID NO: 4 Start Site | SEQ ID NO: 4 Stop Site | Sequence (5' to 3') | FXII (% UTC) | SEQ ID NO |
|---|---|---|---|---|---|---|---|
| 1124165 | 3458 | 3477 | 34 | 53 | TCATGGCATCCGTCCGTTGG | 60 | 617 |
| 1126245 | 10846 | 10865 | N/A | N/A | CCTTCTCAGCATTTTCAAAG | 77 | 618 |
| 1124166 | 3459 | 3478 | 35 | 54 | CTCATGGCATCCGTCCGTTG | 52 | 619 |

Example 2: Effects of 5-10-5 MOE Gapmers on Human FXII RNA In Vitro, Single Dose Modified oligonucleotides complementary to a FXII nucleic acid were synthesized and tested for their effect on FXII RNA levels in vitro. The modified oligonucleotides were tested in a series of experiments using similar culture conditions. The results for each separate experiment are presented in separate tables below.

The modified oligonucleotides in the tables below 5-10-5 MOE gapmers (i.e., they have a central region of ten 2'-deoxynucleosides flanked on each side by wings, each comprising five 2'-MOE nucleosides). The motif for the gapmers is (from 5' to 3'): eeeeedddddddddddeeeee; wherein "d" represents a 2'-β-D-deoxyribosyl sugar moiety, and 'e' represents a 2'-MOE sugar moiety. The internucleoside linkage motif for the gapmers is (from 5' to 3'): soooossssssssssooss; wherein 'o' represents a phosphodiester internucleoside linkage and 's' represents a phosphorothioate internucleoside linkage. Each cytosine residue is a 5-methyl cytosine.

"Start site" indicates the 5'-most nucleoside of the target sequence to which the modified oligonucleotide is complementary. "Stop site" indicates the 3'-most nucleoside of the target sequence to which the modified oligonucleotide is complementary. As shown in the tables below, the modified oligonucleotides are 100% complementary to one or more of human FXII target sequences including the human FXII mRNA sequence designated herein as SEQ ID NO: 1 (ENSEMBL ID ENST00000253496.3 from ENSEMBL version 99: January 2020), the human FXII genomic sequence, designated herein as SEQ ID NO: 2 (ENSEMBL ID ENSG00000131187.9 from ENSEMBL version 99: January 2020), the human FXII genomic sequence, designated herein as SEQ ID No. 3 (the complement of GENBANK Accession No. NC_000005.10 truncated from truncated from nucleotides 177399001 to 177413000), and the human FXII mRNA sequence designated herein as SEQ ID No: 4 (GENBANK Accession No. NM 000505.3). 'N/A' indicates that the modified oligonucleotide is not complementary to that particular target sequence with 100% complementarity.

Cultured Huh7 cells, at a density of 20,000 cells per well, were transfected using electroporation with either 5000 nM or 2000 nM modified oligonucleotide. After a treatment period of approximately 24 hours, RNA was isolated from the cells and FXII RNA levels were measured by quantitative real-time RTPCR. Human primer probe set RTS40528 (described herein above) was used to measure RNA levels. FXII RNA levels were normalized to total RNA content, as measured by RIBOGREEN®. Reduction of FXII RNA is presented in the tables below as percent FXII RNA relative to the amount in untreated control cells (% UTC). The symbol "†" indicates that the modified oligonucleotide is complementary to the target transcript within the amplicon region of the primer probe set. In such instances, additional assays using alternative primer probes must be performed to accurately assess the potency and efficacy of such modified oligonucleotides.

TABLE 12

Reduction of FXII RNA by 5-10-5 MOE gapmers with
mixed PO/PS internucleoside linkages (Huh7,
electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130742 | 2 | 21 | 2 | 21 | TCCAGGAGTCCAGATCAATA | 67 | 620 |
| 1130770 | 37 | 56 | 37 | 56 | CCCTCATGGCATCCGTCCGT | 68 | 621 |
| 1130798 | 84 | 103 | 84 | 103 | AAGTGTTGACTCCAAGCTCA | 90 | 622 |
| 1130826 | 142 | 161 | 509 | 528 | CTGTGTGCTCTTCAGCTTTG | 13 | 623 |
| 1130854 | 178 | 197 | 3529 | 3548 | GGAAGTGGCAGGGCTCCCCG | 47 | 624 |
| 1130871 | 216 | 235 | 3567 | 3586 | GGTACATTTGTGGTACAGCT | 18 | 183 |
| 1130883 | 232 | 251 | 3583 | 3602 | CTGGCCGGCCCTTGTGGGTA | 21 | 625 |
| 1130911 | 297 | 316 | 3804 | 3823 | CAAACAGTATCCCCATCGCT | 28 | 626 |
| 1130939 | 338 | 357 | 4146 | 4165 | GGGCTGTGTTTGCTGCAGTG | 22 | 627 |
| 1130967 | 410 | 429 | 4218 | 4237 | CCAGTGAGGTGTTGTGGACA | 68 | 628 |
| 1130995 | 453 | 472 | 4398 | 4417 | GAGAAGCTGAGGCTCAAAGC | 38 | 629 |
| 1131023 | 498 | 517 | 4443 | 4462 | TGCTTGCTCAGTTCTATACC | 20 | 630 |
| 1131051 | 538 | 557 | 4483 | 4502 | AGTGGGCATCAGGACCCTTG | 93 | 277 |
| 1131079 | 573 | 592 | N/A | N/A | GTTGGTGCGGCAGGCCTGGC | 37 | 631 |
| 1131107 | 613 | 632 | 4697 | 4716 | GGCCCTCCACCTCTAGGCAG | 28 | 632 |
| 1131135 | 658 | 677 | 4742 | 4761 | CGCAGAAGGCTCCGGTGTAG | 54 | 633 |
| 1131163 | 715 | 734 | 4944 | 4963 | CCAGGCCGCGGTAGCTGAGC | 40 | 634 |
| 1131191 | 768 | 787 | 4997 | 5016 | GGTGGCCTCCGAGGCCCACG | 83 | 635 |
| 1131219 | 864 | 883 | 5178 | 5197 | GAAGCACCACGGGCGGATGT | 44 | 636 |
| 1131247 | 908 | 927 | 5222 | 5241 | GCCAGGTCGCAGTACTCCCA | 19 | 637 |
| 1131275 | 999 | 1018 | 5313 | 5332 | CGGCGGTGCCGGCTGCGCGG | 70 | 638 |
| 1131303 | 1077 | 1096 | 5496 | 5515 | AGGCGGCTGCTCCCGCTTCG | 38 | 639 |
| 1131331 | 1123 | 1142 | 5542 | 5561 | TGCGGAGCCGCTGCCCGCAG | 125 | 640 |
| 1131359 | 1159 | 1178 | 5578 | 5597 | GCCCGCCAACGACGCGGGTC | 56 | 641 |
| 1131387 | 1230 | 1249 | 5649 | 5668 | GCTGCCGGCGCAGAAACTGT | 57 | 642 |
| 1131415 | 1316 | 1335 | 5976 | 5995 | TGGCCGAGCACCACCGTCAG | 51 | 643 |
| 1131443 | 1402 | 1421 | 6062 | 6081 | AGCTGACGGGCGAGAAGGCC | 36 | 644 |
| 1131471 | 1465 | 1484 | 6208 | 6227 | ACAGGAGCGCGCAGCTGCCG | 30 | 645 |
| 1131499 | 1553 | 1572 | 6296 | 6315 | TGGTGGCCCCAGCCGGCCAC | 61 | 646 |
| 1131527 | 1585 | 1604 | 6883 | 6902 | GGAAGCTGGCATATTCCTCC | 57 | 647 |
| 1131555 | 1660 | 1679 | 6958 | 6977 | GGAGGATGGAGGATCCGTGC | 7† | 648 |
| 1131583 | 1751 | 1770 | 7139 | 7158 | GCAGCTTGGTCCTCACACAC | 8† | 649 |
| 1131611 | 1798 | 1817 | 7186 | 7205 | AGCCCGATCCCCAGCTGATG | 33 | 650 |
| 1131639 | 1845 | 1864 | 7233 | 7252 | GTAGTAGGCCACATCGGTGT | 62 | 651 |
| 1131667 | 1877 | 1896 | 7265 | 7284 | CAGGAAACGGTGTGCTCCCG | 28 | 652 |

TABLE 12-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131695 | 1921 | 1940 | 7309 | 7328 | CACTGCGGAATCACCAAGGA | 13 | 653 |
| 1131723 | 1956 | 1975 | 7344 | 7363 | ACACAATCTTGCCTTCCATG | 26 | 654 |
| 1131751 | 2012 | 2031 | 7400 | 7419 | CTTTATTGAGTTCCTGCGCC | 20 | 95 |
| 1131779 | N/A | N/A | 109 | 128 | TCCTGGTTCCCACAGCACTC | 71 | 655 |
| 1131807 | N/A | N/A | 193 | 212 | CCTAGTCACCTGGACCCACA | 56 | 656 |
| 1131835 | N/A | N/A | 289 | 308 | CAGAAATGCAGGCTGTGCCC | 71 | 657 |
| 1131863 | N/A | N/A | 386 | 405 | TGCAGCTTCCTCTCACAGCC | 120 | 658 |
| 1131891 | N/A | N/A | 513 | 532 | CCGACTGTGTGCTCTTCAGC | 21 | 659 |
| 1131919 | N/A | N/A | 618 | 637 | ACCTAGCACCAGGTAGGCAC | 39 | 660 |
| 1131947 | N/A | N/A | 724 | 743 | CTCAAGCACCTGCTCCGAGC | 54 | 661 |
| 1131975 | N/A | N/A | 874 | 893 | GATCCTTCCTTGCCCATTGA | 122 | 662 |
| 1132003 | N/A | N/A | 972 | 991 | TGAAGCTTGGAGAACTCAAA | 76 | 663 |
| 1132031 | N/A | N/A | 1079 | 1098 | AGCATTTCCATGCACCAGGT | 70 | 664 |
| 1132059 | N/A | N/A | 1212 | 1231 | GCCTGGCATGTAGGTAATTT | 60 | 665 |
| 1132087 | N/A | N/A | 1590 | 1609 | TGCTTAGAGACTCAACCCCA | 67 | 666 |
| 1132115 | N/A | N/A | 1762 | 1781 | AAGATGCAGATGGGATGGAC | 79 | 667 |
| 1132143 | N/A | N/A | 2138 | 2157 | AAAGTGCACTTGCCAAGGAC | 60 | 668 |
| 1132171 | N/A | N/A | 2268 | 2287 | AATGAGAATTGCCTGTGTCT | 41 | 669 |
| 1132199 | N/A | N/A | 2382 | 2401 | CAGATTATATGCTGTTGGTT | 49 | 670 |
| 1132227 | N/A | N/A | 2516 | 2535 | AAGGCTACCTTAGGGAGAAA | 48 | 671 |
| 1132255 | N/A | N/A | 2643 | 2662 | GAATGAGTGTCCTTCTCAGT | 46 | 672 |
| 1132283 | N/A | N/A | 2751 | 2770 | TTTTCATGGCCATTTGTGGG | 60 | 673 |
| 1132311 | N/A | N/A | 2848 | 2867 | AATAGTACAGTTGATCCTCA | 46 | 674 |
| 1132339 | N/A | N/A | 2959 | 2978 | GAAGAGCACTTGCCACAAAG | 106 | 675 |
| 1132367 | N/A | N/A | 3060 | 3079 | AAAAAAAACTTGGGTTCAGG | 133 | 676 |
| 1132395 | N/A | N/A | 3451 | 3470 | GCTCAGGCACTGTCCCTCAG | 41 | 677 |
| 1132423 | N/A | N/A | 3652 | 3671 | ACAGGCAGGGTACATGTCTC | 45 | 678 |
| 1132451 | N/A | N/A | 3761 | 3780 | GTAGCACACCTGTAGAAAGA | 45 | 679 |
| 1132479 | N/A | N/A | 3919 | 3938 | GTCCAGAATCCCAGGTGTGT | 46 | 680 |
| 1132507 | N/A | N/A | 4030 | 4049 | CTACTCCAAGTTTCCAAGCT | 97 | 681 |
| 1132535 | N/A | N/A | 4137 | 4156 | TTGCTGCAGTGGTCTGAGAG | 36 | 682 |
| 1132563 | N/A | N/A | 4328 | 4347 | TGCCAAGTCTCCGAGTATCC | 56 | 683 |
| 1132591 | N/A | N/A | 4563 | 4582 | CTCCTGCCAGCCTGTCTTCC | 70 | 684 |
| 1132619 | N/A | N/A | 4763 | 4782 | CAGACCCTCACTCACCCACG | 67 | 685 |
| 1132647 | N/A | N/A | 4878 | 4897 | GCTCCCTGGGCAGCCAAGGC | 37 | 686 |

TABLE 12-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132675 | N/A | N/A | 5398 | 5417 | CCTCTCGGCTCCTCCTTCCC | 78 | 687 |
| 1132703 | N/A | N/A | 5766 | 5785 | TGGAAGCTGCGCTGGGAGAC | 122 | 688 |
| 1132731 | N/A | N/A | 6173 | 6192 | AGGCGCAACAGAGCTAACCC | 32 | 689 |
| 1132759 | N/A | N/A | 6388 | 6407 | GATACCAAAGTCGCGGGCTT | 100 | 690 |
| 1132787 | N/A | N/A | 6512 | 6531 | GTATCCCCAGGAGATTTGGG | 66 | 691 |
| 1132815 | N/A | N/A | 6636 | 6655 | CCCACCACCCATCCAGAGTC | 56 | 692 |
| 1132843 | N/A | N/A | 6727 | 6746 | GGTGCCATTAATTCAATTTC | 109 | 693 |
| 1132871 | N/A | N/A | 6868 | 6887 | CCTCCGCCCCTGCAACACA | 55 | 694 |

TABLE 13

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130743 | 3 | 22 | 3 | 22 | ATCCAGGAGTCCAGATCAAT | 48 | 695 |
| 1130771 | 38 | 57 | 38 | 57 | GCCCTCATGGCATCCGTCCG | 57 | 696 |
| 1130799 | 85 | 104 | 85 | 104 | AAAGTGTTGACTCCAAGCTC | 53 | 697 |
| 1130827 | 144 | 163 | 511 | 530 | GACTGTGTGCTCTTCAGCTT | 32 | 698 |
| 1130855 | 197 | 216 | 3548 | 3567 | TGCCGGTGGTACTGGAAGGG | 53 | 699 |
| 1130871 | 216 | 235 | 3567 | 3586 | GGTACATTTGTGGTACAGCT | 13 | 183 |
| 1130884 | 233 | 252 | 3584 | 3603 | CCTGGCCGGCCCTTGTGGGT | 50 | 700 |
| 1130912 | 298 | 317 | 3805 | 3824 | CCAAACAGTATCCCCATCGC | 25 | 701 |
| 1130940 | 357 | 376 | 4165 | 4184 | GGTCCCTCCTTTCTGGCAGG | 76 | 702 |
| 1130968 | 411 | 430 | 4219 | 4238 | TCCAGTGAGGTGTTGTGGAC | 42 | 703 |
| 1130996 | 456 | 475 | 4401 | 4420 | CCGGAGAAGCTGAGGCTCAA | 22 | 704 |
| 1131024 | 499 | 518 | 4444 | 4463 | CTGCTTGCTCAGTTCTATAC | 14 | 705 |
| 1131052 | 539 | 558 | 4484 | 4503 | CAGTGGGCATCAGGACCCTT | 46 | 706 |
| 1131080 | 574 | 593 | N/A | N/A | GGTTGGTGCGGCAGGCCTGG | 22 | 707 |
| 1131108 | 615 | 634 | 4699 | 4718 | GTGGCCCTCCACCTCTAGGC | 62 | 708 |
| 1131136 | 660 | 679 | 4744 | 4763 | GTCGCAGAAGGCTCCGGTGT | 64 | 709 |
| 1131164 | 716 | 735 | 4945 | 4964 | GCCAGGCCGCGGTAGCTGAG | 46 | 710 |
| 1131192 | 772 | 791 | 5001 | 5020 | GGTAGGTGGCCTCCGAGGCC | 52 | 711 |
| 1131220 | 865 | 884 | 5179 | 5198 | CGAAGCACCACGGGCGGATG | 95 | 712 |
| 1131248 | 909 | 928 | 5223 | 5242 | TGCCAGGTCGCAGTACTCCC | 29 | 713 |

TABLE 13-continued

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131276 | 1000 | 1019 | 5314 | 5333 | TCGGCGGTGCCGGCTGCGCG | 39 | 714 |
| 1131304 | 1078 | 1097 | 5497 | 5516 | AAGGCGGCTGCTCCCGCTTC | 78 | 715 |
| 1131332 | 1124 | 1143 | 5543 | 5562 | TTGCGGAGCCGCTGCCCGCA | 65 | 716 |
| 1131360 | 1161 | 1180 | 5580 | 5599 | CAGCCCGCCAACGACGCGGG | 62 | 717 |
| 1131388 | 1232 | 1251 | 5651 | 5670 | AGGCTGCCGGCGCAGAAACT | 34 | 718 |
| 1131416 | 1317 | 1336 | 5977 | 5996 | CTGGCCGAGCACCACCGTCA | 13 | 719 |
| 1131444 | 1405 | 1424 | 6065 | 6084 | GGTAGCTGACGGGCGAGAAG | 48 | 720 |
| 1131472 | 1467 | 1486 | 6210 | 6229 | CGACAGGAGCGCGCAGCTGC | 59 | 721 |
| 1131500 | 1554 | 1573 | 6297 | 6316 | CTGGTGGCCCCAGCCGGCCA | 53 | 722 |
| 1131528 | 1586 | 1605 | 6884 | 6903 | AGGAAGCTGGCATATTCCTC | 47 | 723 |
| 1131556 | 1679 | 1698 | 6977 | 6996 | CCTGCGCAGAGCATGCCGGG | 71† | 75 |
| 1131584 | 1752 | 1771 | 7140 | 7159 | TGCAGCTTGGTCCTCACACA | 17† | 724 |
| 1131612 | 1799 | 1818 | 7187 | 7206 | CAGCCCGATCCCCAGCTGAT | 80 | 725 |
| 1131640 | 1846 | 1865 | 7234 | 7253 | GGTAGTAGGCCACATCGGTG | 19 | 726 |
| 1131668 | 1878 | 1897 | 7266 | 7285 | TCAGGAAACGGTGTGCTCCC | 46 | 727 |
| 1131696 | 1922 | 1941 | 7310 | 7329 | TCACTGCGGAATCACCAAGG | 21 | 728 |
| 1131724 | 1958 | 1977 | 7346 | 7365 | GGACACAATCTTGCCTTCCA | 7 | 729 |
| 1131752 | 2013 | 2032 | 7401 | 7420 | ACTTTATTGAGTTCCTGCGC | 11 | 162 |
| 1131780 | N/A | N/A | 112 | 131 | CAATCCTGGTTCCCACAGCA | 64 | 730 |
| 1131808 | N/A | N/A | 196 | 215 | CCTCCTAGTCACCTGGACCC | 60 | 731 |
| 1131836 | N/A | N/A | 292 | 311 | CCCCAGAAATGCAGGCTGTG | 114 | 732 |
| 1131864 | N/A | N/A | 389 | 408 | GTCTGCAGCTTCCTCTCACA | 56 | 733 |
| 1131892 | N/A | N/A | 516 | 535 | TTACCGACTGTGTGCTCTTC | 18 | 734 |
| 1131920 | N/A | N/A | 621 | 640 | AAGACCTAGCACCAGGTAGG | 58 | 735 |
| 1131948 | N/A | N/A | 727 | 746 | TATCTCAAGCACCTGCTCCG | 25 | 736 |
| 1131976 | N/A | N/A | 877 | 896 | CTTGATCCTTCCTTGCCCAT | 58 | 737 |
| 1132004 | N/A | N/A | 975 | 994 | AATTGAAGCTTGGAGAACTC | 99 | 738 |
| 1132032 | N/A | N/A | 1082 | 1101 | TAAAGCATTTCCATGCACCA | 93 | 739 |
| 1132060 | N/A | N/A | 1215 | 1234 | CATGCCTGGCATGTAGGTAA | 53 | 740 |
| 1132088 | N/A | N/A | 1593 | 1612 | CCATGCTTAGAGACTCAACC | 82 | 741 |
| 1132116 | N/A | N/A | 1765 | 1784 | AAAAAGATGCAGATGGGATG | 86 | 742 |
| 1132144 | N/A | N/A | 2141 | 2160 | GGCAAAGTGCACTTGCCAAG | 85 | 743 |
| 1132172 | N/A | N/A | 2271 | 2290 | AATAATGAGAATTGCCTGTG | 117 | 744 |
| 1132200 | N/A | N/A | 2385 | 2404 | AACCAGATTATATGCTGTTG | 41 | 745 |
| 1132228 | N/A | N/A | 2519 | 2538 | AAGAAGGCTACCTTAGGGAG | 40 | 746 |
| 1132256 | N/A | N/A | 2646 | 2665 | ATTGAATGAGTGTCCTTCTC | 50 | 747 |

TABLE 13-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132284 | N/A | N/A | 2754 | 2773 | ATGTTTTCATGGCCATTTGT | 45 | 748 |
| 1132312 | N/A | N/A | 2851 | 2870 | AATAATAGTACAGTTGATCC | 62 | 749 |
| 1132340 | N/A | N/A | 2962 | 2981 | CAGGAAGAGCACTTGCCACA | 52 | 750 |
| 1132368 | N/A | N/A | 3370 | 3389 | CTCTAAAAGTTGGGTTCAGG | 51 | 751 |
| 1132396 | N/A | N/A | 3457 | 3476 | TCAACTGCTCAGGCACTGTC | 53 | 752 |
| 1132424 | N/A | N/A | 3655 | 3674 | AGGACAGGCAGGGTACATGT | 51 | 753 |
| 1132452 | N/A | N/A | 3764 | 3783 | GTGGTAGCACACCTGTAGAA | 28 | 754 |
| 1132480 | N/A | N/A | 3922 | 3941 | TGGGTCCAGAATCCCAGGTG | 59 | 755 |
| 1132508 | N/A | N/A | 4033 | 4052 | TTGCTACTCCAAGTTTCCAA | 50 | 756 |
| 1132536 | N/A | N/A | 4140 | 4159 | TGTTTGCTGCAGTGGTCTGA | 21 | 757 |
| 1132564 | N/A | N/A | 4334 | 4353 | GGACCATGCCAAGTCTCCGA | 41 | 758 |
| 1132592 | N/A | N/A | 4566 | 4585 | GGCCTCCTGCCAGCCTGTCT | 49 | 759 |
| 1132620 | N/A | N/A | 4766 | 4785 | CCCCAGACCCTCACTCACCC | 90 | 760 |
| 1132648 | N/A | N/A | 4899 | 4918 | TGGTGTCTGAGGAGAAAGGG | 71 | 761 |
| 1132676 | N/A | N/A | 5401 | 5420 | CGCCCTCTCGGCTCCTCCTT | 44 | 762 |
| 1132704 | N/A | N/A | 5841 | 5860 | CTCCCCGGGAGCTCCGGAGG | 123 | 763 |
| 1132732 | N/A | N/A | 6176 | 6195 | TGAAGGCGCAACAGAGCTAA | 21 | 764 |
| 1132760 | N/A | N/A | 6394 | 6413 | CGGAACGATACCAAAGTCGC | 85 | 765 |
| 1132788 | N/A | N/A | 6515 | 6534 | CCTGTATCCCCAGGAGATTT | 21 | 766 |
| 1132816 | N/A | N/A | 6639 | 6658 | TCCCCCACCACCCATCCAGA | 87 | 767 |
| 1132844 | N/A | N/A | 6730 | 6749 | GGAGGTGCCATTAATTCAAT | 46 | 768 |
| 1132872 | N/A | N/A | 6871 | 6890 | ATTCCTCCGCCCCTGCGAAC | 150 | 769 |

TABLE 14

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130800 | 89 | 108 | N/A | N/A | ATCGAAAGTGTTGACTCCAA | 28 | 770 |
| 1130828 | 145 | 164 | 512 | 531 | CGACTGTGTGCTCTTCAGCT | 14 | 771 |
| 1130856 | 199 | 218 | 3550 | 3569 | GCTGCCGGTGGTACTGGAAG | 22 | 772 |
| 1130871 | 216 | 235 | 3567 | 3586 | GGTACATTTGTGGTACAGCT | 21 | 183 |
| 1130885 | 234 | 253 | 3585 | 3604 | GCCTGGCCGGCCCTTGTGGG | 51 | 773 |
| 1130913 | 304 | 323 | 3811 | 3830 | TGGGCTCCAAACAGTATCCC | 22 | 774 |

TABLE 14-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130941 | 359 | 378 | 4167 | 4186 | CAGGTCCCTCCTTTCTGGCA | 46 | 775 |
| 1130969 | 413 | 432 | 4221 | 4240 | TTTCCAGTGAGGTGTTGTGG | 25 | 776 |
| 1130997 | 457 | 476 | 4402 | 4421 | ACCGGAGAAGCTGAGGCTCA | 19 | 777 |
| 1131025 | 500 | 519 | 4445 | 4464 | GCTGCTTGCTCAGTTCTATA | 19 | 778 |
| 1131053 | 540 | 559 | 4485 | 4504 | GCAGTGGGCATCAGGACCCT | 22 | 779 |
| 1131081 | 576 | 595 | N/A | N/A | CGGGTTGGTGCGGCAGGCCT | 65 | 780 |
| 1131109 | 616 | 635 | 4700 | 4719 | GGTGGCCCTCCACCTCTAGG | 38 | 781 |
| 1131137 | 661 | 680 | 4745 | 4764 | CGTCGCAGAAGGCTCCGGTG | 94 | 782 |
| 1131165 | 717 | 736 | 4946 | 4965 | GGCCAGGCCGCGGTAGCTGA | 35 | 783 |
| 1131193 | 773 | 792 | 5002 | 5021 | CGGTAGGTGGCCTCCGAGGC | 30 | 784 |
| 1131221 | 867 | 886 | 5181 | 5200 | CACGAAGCACCACGGGCGGA | 38 | 785 |
| 1131249 | 911 | 930 | 5225 | 5244 | TGTGCCAGGTCGCAGTACTC | 24 | 786 |
| 1131277 | 1001 | 1020 | 5315 | 5334 | TTCGGCGGTGCCGGCTGCGC | 25 | 787 |
| 1131305 | 1079 | 1098 | 5498 | 5517 | GAAGGCGGCTGCTCCCGCTT | 39 | 788 |
| 1131333 | 1126 | 1145 | 5545 | 5564 | TCTTGCGGAGCCGCTGCCCG | 34 | 789 |
| 1131361 | 1162 | 1181 | 5581 | 5600 | CCAGCCCGCCAACGACGCGG | 31 | 790 |
| 1131389 | 1233 | 1252 | 5652 | 5671 | GAGGCTGCCGGCGCAGAAAC | 39 | 791 |
| 1131417 | 1318 | 1337 | 5978 | 5997 | CCTGGCCGAGCACCACCGTC | 26 | 792 |
| 1131445 | 1408 | 1427 | 6068 | 6087 | GCTGGTAGCTGACGGGCGAG | 26 | 793 |
| 1131473 | 1468 | 1487 | 6211 | 6230 | GCGACAGGAGCGCGCAGCTG | 21 | 794 |
| 1131501 | 1555 | 1574 | 6298 | 6317 | ACTGGTGGCCCCAGCCGGCC | 51 | 795 |
| 1131529 | 1587 | 1606 | 6885 | 6904 | CAGGAAGCTGGCATATTCCT | 82 | 796 |
| 1131557 | 1680 | 1699 | 6978 | 6997 | CCCTGCGCAGAGCATGCCGG | 28† | 797 |
| 1131585 | 1753 | 1772 | 7141 | 7160 | CTGCAGCTTGGTCCTCACAC | 6† | 798 |
| 1131613 | 1800 | 1819 | 7188 | 7207 | ACAGCCCGATCCCCAGCTGA | 39 | 799 |
| 1131641 | 1847 | 1866 | 7235 | 7254 | AGGTAGTAGGCCACATCGGT | 19 | 800 |
| 1131669 | 1879 | 1898 | 7267 | 7286 | ATCAGGAAACGGTGTGCTCC | 24 | 801 |
| 1131697 | 1923 | 1942 | 7311 | 7330 | CTCACTGCGGAATCACCAAG | 8 | 802 |
| 1131725 | 1960 | 1979 | 7348 | 7367 | TGGGACACAATCTTGCCTTC | 12 | 803 |
| 1131753 | 2014 | 2033 | 7402 | 7421 | CACTTTATTGAGTTCCTGCG | 15 | 163 |
| 1131781 | N/A | N/A | 115 | 134 | GGACAATCCTGGTTCCCACA | 71 | 804 |
| 1131809 | N/A | N/A | 199 | 218 | AGGCCTCCTAGTCACCTGGA | 58 | 805 |
| 1131837 | N/A | N/A | 302 | 321 | GGCCCATCTCCCCCAGAAAT | 50 | 806 |
| 1131865 | N/A | N/A | 392 | 411 | CTAGTCTGCAGCTTCCTCTC | 48 | 807 |
| 1131893 | N/A | N/A | 519 | 538 | CACTTACCGACTGTGTGCTC | 24 | 808 |

TABLE 14-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131921 | N/A | N/A | 627 | 646 | GGGCATAAGACCTAGCACCA | 46 | 809 |
| 1131949 | N/A | N/A | 730 | 749 | ACATATCTCAAGCACCTGCT | 63 | 810 |
| 1131977 | N/A | N/A | 880 | 899 | GCTCTTGATCCTTCCTTGCC | 54 | 811 |
| 1132005 | N/A | N/A | 997 | 1016 | AACCTGGTTTCACAGAAGGG | 54 | 812 |
| 1132033 | N/A | N/A | 1085 | 1104 | TTGTAAAGCATTTCCATGCA | 37 | 813 |
| 1132061 | N/A | N/A | 1512 | 1531 | ACTCTAGGTAAATTTTTTTT | 86 | 814 |
| 1132089 | N/A | N/A | 1612 | 1631 | AATGTGCTGGGCCTCAACGC | 49 | 815 |
| 1132117 | N/A | N/A | 1908 | 1927 | AAGTTGTGTGCCTGTAATCC | 50 | 816 |
| 1132145 | N/A | N/A | 2144 | 2163 | CAAGGCAAAGTGCACTTGCC | 39 | 817 |
| 1132173 | N/A | N/A | 2274 | 2293 | GCGAATAATGAGAATTGCCT | 38 | 818 |
| 1132201 | N/A | N/A | 2388 | 2407 | TAAAACCAGATTATATGCTG | 67 | 819 |
| 1132229 | N/A | N/A | 2522 | 2541 | CACAAGAAGGCTACCTTAGG | 55 | 820 |
| 1132257 | N/A | N/A | 2649 | 2668 | CCTATTGAATGAGTGTCCTT | 48 | 821 |
| 1132285 | N/A | N/A | 2760 | 2779 | CTTGAAATGTTTTCATGGCC | 59 | 822 |
| 1132313 | N/A | N/A | 2854 | 2873 | AGTAATAATAGTACAGTTGA | 59 | 823 |
| 1132341 | N/A | N/A | 2965 | 2984 | GGCCAGGAAGAGCACTTGCC | 59 | 824 |
| 1132369 | N/A | N/A | 3373 | 3392 | CTGCTCTAAAAGTTGGGTTC | 40 | 825 |
| 1132397 | N/A | N/A | 3460 | 3479 | TACTCAACTGCTCAGGCACT | 34 | 826 |
| 1132425 | N/A | N/A | 3658 | 3677 | AGAAGGACAGGCAGGGTACA | 67 | 827 |
| 1132453 | N/A | N/A | 3824 | 3843 | CCTTTCACTTTCTTGGGCTC | 16 | 828 |
| 1132481 | N/A | N/A | 3925 | 3944 | GGCTGGGTCCAGAATCCCAG | 40 | 829 |
| 1132509 | N/A | N/A | 4036 | 4055 | ACCTTGCTACTCCAAGTTTC | 36 | 830 |
| 1132537 | N/A | N/A | 4236 | 4255 | CCTTTCTGGCAGTGGTTTCC | 20 | 831 |
| 1132565 | N/A | N/A | 4337 | 4356 | CTAGGACCATGCCAAGTCTC | 89 | 832 |
| 1132593 | N/A | N/A | 4569 | 4588 | CCCGGCCTCCTGCCAGCCTG | 40 | 833 |
| 1132621 | N/A | N/A | 4769 | 4788 | TTGCCCCAGACCCTCACTCA | 47 | 834 |
| 1132649 | N/A | N/A | 4902 | 4921 | CCTTGGTGTCTGAGGAGAAA | 59 | 835 |
| 1132677 | N/A | N/A | 5418 | 5437 | GAATCTAGCTCGCCCGGCGC | 58 | 836 |
| 1132705 | N/A | N/A | 5844 | 5863 | TTCCTCCCCGGGAGCTCCGG | 65 | 837 |
| 1132733 | N/A | N/A | 6306 | 6325 | ACCCTCGAACTGGTGGCCCC | 59 | 838 |
| 1132761 | N/A | N/A | 6397 | 6416 | ACCCGGAACGATACCAAAGT | 61 | 839 |
| 1132789 | N/A | N/A | 6518 | 6537 | CTCCCTGTATCCCCAGGAGA | 77 | 840 |
| 1132817 | N/A | N/A | 6643 | 6662 | CCCCTCCCCCACCACCCATC | 46 | 841 |

TABLE 14-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132845 | N/A | N/A | 6733 | 6752 | GGAGGAGGTGCCATTAATTC | 61 | 842 |
| 1132873 | N/A | N/A | 6874 | 6893 | CATATTCCTCCGCCCCTGCG | 90 | 843 |

TABLE 15

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130745 | 5 | 24 | 5 | 24 | CTATCCAGGAGTCCAGATCA | 58 | 844 |
| 1130773 | 42 | 61 | 42 | 61 | CAGAGCCCTCATGGCATCCG | 33 | 845 |
| 1130801 | 90 | 109 | N/A | N/A | AATCGAAAGTGTTGACTCCA | 33 | 846 |
| 1130829 | 146 | 165 | N/A | N/A | ACGACTGTGTGCTCTTCAGC | 20 | 176 |
| 1130857 | 200 | 219 | 3551 | 3570 | AGCTGCCGGTGGTACTGGAA | 43 | 847 |
| 1130871 | 216 | 235 | 3567 | 3586 | GGTACATTTGTGGTACAGCT | 18 | 183 |
| 1130886 | 235 | 254 | 3586 | 3605 | GGCCTGGCCGGCCCTTGTGG | 49 | 848 |
| 1130914 | 305 | 324 | 3812 | 3831 | TTGGGCTCCAAACAGTATCC | 20 | 849 |
| 1130942 | 361 | 380 | 4169 | 4188 | CACAGGTCCCTCCTTTCTGG | 62 | 850 |
| 1130970 | 417 | 436 | 4225 | 4244 | GTGGTTTCCAGTGAGGTGTT | 19 | 851 |
| 1130998 | 459 | 478 | 4404 | 4423 | AAACCGGAGAAGCTGAGGCT | 21 | 852 |
| 1131026 | 501 | 520 | 4446 | 4465 | AGCTGCTTGCTCAGTTCTAT | 41 | 853 |
| 1131054 | 542 | 561 | 4487 | 4506 | TGGCAGTGGGCATCAGGACC | 60 | 854 |
| 1131082 | 577 | 596 | N/A | N/A | ACGGGTTGGTGCGGCAGGCC | 31 | 855 |
| 1131110 | 617 | 636 | 4701 | 4720 | CGGTGGCCCTCCACCTCTAG | 44 | 856 |
| 1131138 | 679 | 698 | N/A | N/A | AGCTTGCCTTGGTGTCCACG | 38 | 857 |
| 1131166 | 719 | 738 | 4948 | 4967 | CTGGCCAGGCCGCGGTAGCT | 92 | 858 |
| 1131194 | 774 | 793 | 5003 | 5022 | CCGGTAGGTGGCCTCCGAGG | 44 | 859 |
| 1131222 | 868 | 887 | 5182 | 5201 | GCACGAAGCACCACGGGCGG | 30 | 860 |
| 1131250 | 912 | 931 | 5226 | 5245 | CTGTGCCAGGTCGCAGTACT | 38 | 861 |
| 1131278 | 1003 | 1022 | 5317 | 5336 | GCTTCGGCGGTGCCGGCTGC | 33 | 862 |
| 1131306 | 1080 | 1099 | 5499 | 5518 | GGAAGGCGGCTGCTCCCGCT | 36 | 863 |
| 1131334 | 1127 | 1146 | 5546 | 5565 | CTCTTGCGGAGCCGCTGCCC | 46 | 864 |
| 1131362 | 1164 | 1183 | 5583 | 5602 | CACCAGCCCGCCAACGACGC | 24 | 865 |
| 1131390 | 1234 | 1253 | 5653 | 5672 | TGAGGCTGCCGGCGCAGAAA | 40 | 866 |

TABLE 15-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131418 | 1319 | 1338 | 5979 | 5998 | TCCTGGCCGAGCACCACCGT | 34 | 867 |
| 1131446 | 1410 | 1429 | 6070 | 6089 | GTGCTGGTAGCTGACGGGCG | 26 | 868 |
| 1131474 | 1470 | 1489 | 6213 | 6232 | AGGCGACAGGAGCGCGCAGC | 21 | 869 |
| 1131502 | 1556 | 1575 | 6299 | 6318 | AACTGGTGGCCCCAGCCGGC | 47 | 870 |
| 1131530 | 1588 | 1607 | 6886 | 6905 | GCAGGAAGCTGGCATATTCC | 58 | 871 |
| 1131558 | 1681 | 1700 | 6979 | 6998 | ACCCTGCGCAGAGCATGCCG | 20† | 872 |
| 1131586 | 1755 | 1774 | 7143 | 7162 | CTCTGCAGCTTGGTCCTCAC | 14† | 873 |
| 1131614 | 1801 | 1820 | 7189 | 7208 | CACAGCCCGATCCCCAGCTG | 38 | 874 |
| 1131642 | 1848 | 1867 | 7236 | 7255 | CAGGTAGTAGGCCACATCGG | 35 | 875 |
| 1131670 | 1881 | 1900 | 7269 | 7288 | CAATCAGGAAACGGTGTGCT | 47 | 876 |
| 1131698 | 1924 | 1943 | 7312 | 7331 | TCTCACTGCGGAATCACCAA | 6 | 877 |
| 1131726 | 1961 | 1980 | 7349 | 7368 | ATGGGACACAATCTTGCCTT | 34 | 878 |
| 1131754 | 2015 | 2034 | 7403 | 7422 | GCACTTTATTGAGTTCCTGC | 4 | 164 |
| 1131782 | N/A | N/A | 118 | 137 | CTGGGACAATCCTGGTTCCC | 56 | 879 |
| 1131810 | N/A | N/A | 202 | 221 | CATAGGCCTCCTAGTCACCT | 94 | 880 |
| 1131838 | N/A | N/A | 305 | 324 | TAAGGCCCATCTCCCCCAGA | 41 | 881 |
| 1131866 | N/A | N/A | 395 | 414 | TTGCTAGTCTGCAGCTTCCT | 60 | 882 |
| 1131894 | N/A | N/A | 523 | 542 | AGGCCACTTACCGACTGTGT | 109 | 883 |
| 1131922 | N/A | N/A | 630 | 649 | CATGGGCATAAGACCTAGCA | 65 | 884 |
| 1131950 | N/A | N/A | 733 | 752 | AGCACATATCTCAAGCACCT | 85 | 885 |
| 1131978 | N/A | N/A | 886 | 905 | AGACAAGCTCTTGATCCTTC | 79 | 886 |
| 1132006 | N/A | N/A | 1000 | 1019 | ATCAACCTGGTTTCACAGAA | 48 | 887 |
| 1132034 | N/A | N/A | 1088 | 1107 | TATTTGTAAAGCATTTCCAT | 67 | 888 |
| 1132062 | N/A | N/A | 1515 | 1534 | CACACTCTAGGTAAATTTTT | 59 | 889 |
| 1132090 | N/A | N/A | 1615 | 1634 | TGGAATGTGCTGGGCCTCAA | 59 | 890 |
| 1132118 | N/A | N/A | 1911 | 1930 | ATGAAGTTGTGTGCCTGTAA | 61 | 891 |
| 1132146 | N/A | N/A | 2147 | 2166 | GTTCAAGGCAAAGTGCACTT | 56 | 892 |
| 1132174 | N/A | N/A | 2277 | 2296 | ATCGCGAATAATGAGAATTG | 68 | 893 |
| 1132202 | N/A | N/A | 2391 | 2410 | ACATAAAACCAGATTATATG | 52 | 894 |
| 1132230 | N/A | N/A | 2525 | 2544 | AAGCACAAGAAGGCTACCTT | 33 | 895 |
| 1132258 | N/A | N/A | 2652 | 2671 | TCTCCTATTGAATGAGTGTC | 36 | 896 |
| 1132286 | N/A | N/A | 2765 | 2784 | CAATACTTGAAATGTTTTCA | 47 | 897 |
| 1132314 | N/A | N/A | 2857 | 2876 | GGCAGTAATAATAGTACAGT | 38 | 898 |
| 1132342 | N/A | N/A | 2968 | 2987 | CAAGGCCAGGAAGAGCACTT | 76 | 899 |
| 1132370 | N/A | N/A | 3376 | 3395 | TTTCTGCTCTAAAAGTTGGG | 35 | 900 |

TABLE 15-continued

Reduction of FXII RNA by 5-10-5 MOE gapmers with mixed
PO/PS internucleoside linkages (Huh7, electroporation,
5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132398 | N/A | N/A | 3463 | 3482 | CTGTACTCAACTGCTCAGGC | 60 | 901 |
| 1132426 | N/A | N/A | 3661 | 3680 | GACAGAAGGACAGGCAGGGT | 52 | 902 |
| 1132454 | N/A | N/A | 3827 | 3846 | GCACCTTTCACTTTCTTGGG | 24 | 903 |
| 1132482 | N/A | N/A | 3945 | 3964 | TATTGTGGAGGGAGAGAAGG | 83 | 904 |
| 1132510 | N/A | N/A | 4039 | 4058 | GTGACCTTGCTACTCCAAGT | 74 | 905 |
| 1132538 | N/A | N/A | 4239 | 4258 | TCACCTTTCTGGCAGTGGTT | 44 | 906 |
| 1132566 | N/A | N/A | 4340 | 4359 | AGTCTAGGACCATGCCAAGT | 34 | 907 |
| 1132594 | N/A | N/A | 4572 | 4591 | CCACCCGGCCTCCTGCCAGC | 75 | 908 |
| 1132622 | N/A | N/A | 4772 | 4791 | TGCTTGCCCCAGACCCTCAC | 54 | 909 |
| 1132650 | N/A | N/A | 4905 | 4924 | TTGCCTTGGTGTCTGAGGAG | 44 | 910 |
| 1132678 | N/A | N/A | 5421 | 5440 | CCGGAATCTAGCTCGCCCGG | 50 | 911 |
| 1132706 | N/A | N/A | 5847 | 5866 | AGCTTCCTCCCCGGGAGCTC | 64 | 912 |
| 1132734 | N/A | N/A | 6309 | 6328 | CCTACCCTCGAACTGGTGGC | 61 | 913 |
| 1132762 | N/A | N/A | 6400 | 6419 | GGCACCCGGAACGATACCAA | 63 | 914 |
| 1132790 | N/A | N/A | 6521 | 6540 | ATTCTCCTGTATCCCCAGG | 58 | 915 |
| 1132818 | N/A | N/A | 6646 | 6665 | AAACCCCTCCCCCACCACCC | 41 | 916 |
| 1132846 | N/A | N/A | 6752 | 6771 | CTCGCAGCAAGCCCGAAGGG | 38 | 917 |
| 1132874 | N/A | N/A | 6877 | 6896 | TGGCATATTCCTCCGCCCCT | 49 | 918 |

TABLE 16

Reduction of FXII RNA by 5-10-5 MOE gapmers with mixed
PO/PS internucleoside linkages (Huh7, electroporation,
5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130746 | 7 | 26 | 7 | 26 | GCCTATCCAGGAGTCCAGAT | 29 | 919 |
| 1130774 | 46 | 65 | 46 | 65 | GCAGCAGAGCCCTCATGGCA | 22 | 920 |
| 1130802 | 91 | 110 | N/A | N/A | GAATCGAAAGTGTTGACTCC | 40 | 921 |
| 1130830 | 147 | 166 | N/A | N/A | AACGACTGTGTGCTCTTCAG | 9 | 922 |
| 1130858 | 201 | 220 | 3552 | 3571 | CAGCTGCCGGTGGTACTGGA | 22 | 923 |
| 1130871 | 216 | 235 | 3567 | 3586 | GGTACATTTGTGGTACAGCT | 22 | 183 |
| 1130887 | 236 | 255 | 3587 | 3606 | GGGCCTGGCCGGCCCTTGTG | 41 | 924 |
| 1130915 | 306 | 325 | 3813 | 3832 | CTTGGGCTCCAAACAGTATC | 26 | 925 |
| 1130943 | 362 | 381 | 4170 | 4189 | ACACAGGTCCCTCCTTTCTG | 32 | 926 |
| 1130971 | 419 | 438 | 4227 | 4246 | CAGTGGTTTCCAGTGAGGTG | 38 | 927 |

TABLE 16-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130999 | 460 | 479 | 4405 | 4424 | AAAACCGGAGAAGCTGAGGC | 26 | 928 |
| 1131027 | 502 | 521 | 4447 | 4466 | CAGCTGCTTGCTCAGTTCTA | 35 | 929 |
| 1131055 | 543 | 562 | 4488 | 4507 | CTGGCAGTGGGCATCAGGAC | 33 | 930 |
| 1131083 | 579 | 598 | 4663 | 4682 | GCACGGGTTGGTGCGGCAGG | 29 | 931 |
| 1131111 | 618 | 637 | 4702 | 4721 | GCGGTGGCCCTCCACCTCTA | 54 | 932 |
| 1131139 | 680 | 699 | N/A | N/A | CAGCTTGCCTTGGTGTCCAC | 30 | 933 |
| 1131167 | 720 | 739 | 4949 | 4968 | CCTGGCCAGGCCGCGGTAGC | 80 | 934 |
| 1131195 | 775 | 794 | 5004 | 5023 | TCCGGTAGGTGGCCTCCGAG | 33 | 935 |
| 1131223 | 869 | 888 | 5183 | 5202 | AGCACGAAGCACCACGGGCG | 17 | 936 |
| 1131251 | 913 | 932 | 5227 | 5246 | ACTGTGCCAGGTCGCAGTAC | 26 | 937 |
| 1131279 | 1004 | 1023 | 5318 | 5337 | GGCTTCGGCGGTGCCGGCTG | 24 | 938 |
| 1131307 | 1081 | 1100 | 5500 | 5519 | GGGAAGGCGGCTGCTCCCGC | 40 | 939 |
| 1131335 | 1128 | 1147 | 5547 | 5566 | ACTCTTGCGGAGCCGCTGCC | 43 | 98 |
| 1131363 | 1165 | 1184 | 5584 | 5603 | CCACCAGCCCGCCAACGACG | 59 | 940 |
| 1131391 | 1235 | 1254 | 5654 | 5673 | ATGAGGCTGCCGGCGCAGAA | 49 | 941 |
| 1131419 | 1320 | 1339 | 5980 | 5999 | TTCCTGGCCGAGCACCACCG | 24 | 942 |
| 1131447 | 1411 | 1430 | 6071 | 6090 | CGTGCTGGTAGCTGACGGGC | 25 | 943 |
| 1131475 | 1471 | 1490 | 6214 | 6233 | AAGGCGACAGGAGCGCGCAG | 28 | 944 |
| 1131503 | 1557 | 1576 | 6300 | 6319 | GAACTGGTGGCCCCAGCCGG | 65 | 945 |
| 1131531 | 1592 | 1611 | 6890 | 6909 | TCCTGCAGGAAGCTGGCATA | 88 | 946 |
| 1131559 | 1683 | 1702 | 6981 | 7000 | GAACCCTGCGCAGAGCATGC | 56† | 947 |
| 1131587 | 1757 | 1776 | 7145 | 7164 | CGCTCTGCAGCTTGGTCCTC | 19† | 948 |
| 1131615 | 1802 | 1821 | 7190 | 7209 | CCACAGCCCGATCCCCAGCT | 40 | 949 |
| 1131643 | 1849 | 1868 | 7237 | 7256 | CCAGGTAGTAGGCCACATCG | 44 | 88 |
| 1131671 | 1882 | 1901 | 7270 | 7289 | GCAATCAGGAAACGGTGTGC | 12 | 950 |
| 1131699 | 1926 | 1945 | 7314 | 7333 | TCTCTCACTGCGGAATCACC | 7 | 951 |
| 1131727 | 1962 | 1981 | 7350 | 7369 | AATGGGACACAATCTTGCCT | 25 | 952 |
| 1131755 | 2016 | 2035 | 7404 | 7423 | AGCACTTTATTGAGTTCCTG | 3 | 953 |
| 1131783 | N/A | N/A | 121 | 140 | ATCCTGGGACAATCCTGGTT | 41 | 954 |
| 1131811 | N/A | N/A | 205 | 224 | CCACATAGGCCTCCTAGTCA | 48 | 955 |
| 1131839 | N/A | N/A | 308 | 327 | TCTTAAGGCCCATCTCCCCC | 46 | 956 |
| 1131867 | N/A | N/A | 398 | 417 | CTGTTGCTAGTCTGCAGCTT | 85 | 957 |
| 1131895 | N/A | N/A | 526 | 545 | GCCAGGCCACTTACCGACTG | 40 | 958 |
| 1131923 | N/A | N/A | 633 | 652 | GCCCATGGGCATAAGACCTA | 37 | 959 |
| 1131951 | N/A | N/A | 736 | 755 | AGCAGCACATATCTCAAGCA | 68 | 960 |

TABLE 16-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131979 | N/A | N/A | 889 | 908 | CAGAGACAAGCTCTTGATCC | 44 | 961 |
| 1132007 | N/A | N/A | 1003 | 1022 | GTTATCAACCTGGTTTCACA | 27 | 962 |
| 1132035 | N/A | N/A | 1097 | 1116 | AAAAGCTAATATTTGTAAAG | 42 | 963 |
| 1132063 | N/A | N/A | 1518 | 1537 | TGCCACACTCTAGGTAAATT | 43 | 964 |
| 1132091 | N/A | N/A | 1618 | 1637 | GGTTGGAATGTGCTGGGCCT | 48 | 965 |
| 1132119 | N/A | N/A | 1914 | 1933 | AGCATGAAGTTGTGTGCCTG | 79 | 966 |
| 1132147 | N/A | N/A | 2150 | 2169 | TTTGTTCAAGGCAAAGTGCA | 34 | 967 |
| 1132175 | N/A | N/A | 2280 | 2299 | ACCATCGCGAATAATGAGAA | 32 | 968 |
| 1132203 | N/A | N/A | 2394 | 2413 | CATACATAAAACCAGATTAT | 67 | 969 |
| 1132231 | N/A | N/A | 2533 | 2552 | TAGTTCCTAAGCACAAGAAG | 98 | 970 |
| 1132259 | N/A | N/A | 2655 | 2674 | AGCTCTCCTATTGAATGAGT | 36 | 971 |
| 1132287 | N/A | N/A | 2768 | 2787 | AGTCAATACTTGAAATGTTT | 84 | 972 |
| 1132315 | N/A | N/A | 2860 | 2879 | AACGGCAGTAATAATAGTAC | 55 | 973 |
| 1132343 | N/A | N/A | 2971 | 2990 | TCCCAAGGCCAGGAAGAGCA | 32 | 974 |
| 1132371 | N/A | N/A | 3379 | 3398 | CACTTTCTGCTCTAAAAGTT | 28 | 975 |
| 1132399 | N/A | N/A | 3466 | 3485 | CCCCTGTACTCAACTGCTCA | 42 | 976 |
| 1132427 | N/A | N/A | 3664 | 3683 | TTGGACAGAAGGACAGGCAG | 58 | 977 |
| 1132455 | N/A | N/A | 3830 | 3849 | GTAGCACCTTTCACTTTCTT | 16 | 978 |
| 1132483 | N/A | N/A | 3954 | 3973 | TCCAAAGGGTATTGTGGAGG | 38 | 979 |
| 1132511 | N/A | N/A | 4042 | 4061 | CTTGTGACCTTGCTACTCCA | 28 | 980 |
| 1132539 | N/A | N/A | 4242 | 4261 | TCCTCACCTTTCTGGCAGTG | 27 | 981 |
| 1132567 | N/A | N/A | 4343 | 4362 | GAGAGTCTAGGACCATGCCA | 80 | 982 |
| 1132595 | N/A | N/A | 4575 | 4594 | ACACCACCCGGCCTCCTGCC | 58 | 983 |
| 1132623 | N/A | N/A | 4775 | 4794 | TTCTGCTTGCCCCAGACCCT | 70 | 984 |
| 1132651 | N/A | N/A | 4908 | 4927 | AGCTTGCCTTGGTGTCTGAG | 19 | 985 |
| 1132679 | N/A | N/A | 5424 | 5443 | TGGCCGGAATCTAGCTCGCC | 61 | 986 |
| 1132707 | N/A | N/A | 5850 | 5869 | TCCAGCTTCCTCCCCGGGAG | 51 | 987 |
| 1132735 | N/A | N/A | 6312 | 6331 | GTGCCTACCCTCGAACTGGT | 45 | 988 |
| 1132763 | N/A | N/A | 6403 | 6422 | GTAGGCACCCGGAACGATAC | 27 | 989 |
| 1132791 | N/A | N/A | 6524 | 6543 | TCGATTCTCCCTGTATCCCC | 69 | 990 |
| 1132819 | N/A | N/A | 6649 | 6668 | CAGAAACCCCTCCCCCACCA | 50 | 991 |
| 1132847 | N/A | N/A | 6755 | 6774 | TCTCTCGCAGCAAGCCCGAA | 48 | 992 |
| 1132875 | N/A | N/A | 7010 | 7029 | ACCTGGCACGCATCGGTGCC | 29† | 993 |

TABLE 17

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130747 | 10 | 29 | 10 | 29 | GCTGCCTATCCAGGAGTCCA | 45 | 994 |
| 1130775 | 47 | 66 | 47 | 66 | AGCAGCAGAGCCCTCATGGC | 43 | 995 |
| 1130803 | 93 | 112 | N/A | N/A | TGGAATCGAAAGTGTTGACT | 25 | 996 |
| 1130831 | 148 | 167 | N/A | N/A | GAACGACTGTGTGCTCTTCA | 18 | 997 |
| 1130859 | 203 | 222 | 3554 | 3573 | TACAGCTGCCGGTGGTACTG | 28 | 998 |
| 1130871 | 216 | 235 | 3567 | 3586 | GGTACATTTGTGGTACAGCT | 8 | 183 |
| 1130888 | 238 | 257 | 3589 | 3608 | GAGGGCCTGGCCGGCCCTTG | 77 | 999 |
| 1130916 | 307 | 326 | 3814 | 3833 | TCTTGGGCTCCAAACAGTAT | 33 | 1000 |
| 1130944 | 363 | 382 | 4171 | 4190 | CACACAGGTCCCTCCTTTCT | 53 | 1001 |
| 1130972 | 420 | 439 | 4228 | 4247 | GCAGTGGTTTCCAGTGAGGT | 19 | 1002 |
| 1131000 | 461 | 480 | 4406 | 4425 | AAAAACCGGAGAAGCTGAGG | 25 | 1003 |
| 1131028 | 505 | 524 | 4450 | 4469 | CCACAGCTGCTTGCTCAGTT | 23 | 1004 |
| 1131056 | 545 | 564 | 4490 | 4509 | CGCTGGCAGTGGGCATCAGG | 24 | 1005 |
| 1131084 | 580 | 599 | 4664 | 4683 | GGCACGGGTTGGTGCGGCAG | 19 | 1006 |
| 1131112 | 619 | 638 | 4703 | 4722 | GGCGGTGGCCCTCCACCTCT | 36 | 1007 |
| 1131140 | 681 | 700 | N/A | N/A | GCAGCTTGCCTTGGTGTCCA | 21 | 1008 |
| 1131168 | 721 | 740 | 4950 | 4969 | TCCTGGCCAGGCCGCGGTAG | 37 | 1009 |
| 1131196 | 777 | 796 | 5006 | 5025 | GTTCCGGTAGGTGGCCTCCG | 46 | 1010 |
| 1131224 | 870 | 889 | 5184 | 5203 | CAGCACGAAGCACCACGGGC | 35 | 1011 |
| 1131252 | 914 | 933 | 5228 | 5247 | CACTGTGCCAGGTCGCAGTA | 60 | 1012 |
| 1131280 | 1005 | 1024 | 5319 | 5338 | AGGCTTCGGCGGTGCCGGCT | 31 | 1013 |
| 1131308 | 1085 | 1104 | 5504 | 5523 | GTCAGGGAAGGCGGCTGCTC | 25 | 1014 |
| 1131336 | 1129 | 1148 | 5548 | 5567 | GACTCTTGCGGAGCCGCTGC | 40 | 1015 |
| 1131364 | 1167 | 1186 | 5586 | 5605 | CGCCACCAGCCCGCCAACGA | 43 | 1016 |
| 1131392 | 1237 | 1256 | 5656 | 5675 | CGATGAGGCTGCCGGCGCAG | 30 | 1017 |
| 1131420 | 1322 | 1341 | 5982 | 6001 | CGTTCCTGGCCGAGCACCAC | 34 | 1018 |
| 1131448 | 1430 | 1449 | N/A | N/A | AGGCGCAACAGAGCCAGGTC | 38 | 1019 |
| 1131476 | 1473 | 1492 | 6216 | 6235 | GTAAGGCGACAGGAGCGCGC | 37 | 1020 |
| 1131504 | 1558 | 1577 | 6301 | 6320 | CGAACTGGTGGCCCCAGCCG | 76 | 1021 |
| 1131532 | 1594 | 1613 | 6892 | 6911 | CCTCCTGCAGGAAGCTGGCA | 112 | 1022 |
| 1131560 | 1687 | 1706 | 6985 | 7004 | CGAGGAACCCTGCGCAGAGC | 6† | 1023 |
| 1131588 | 1758 | 1777 | 7146 | 7165 | GCGCTCTGCAGCTTGGTCCT | 16† | 1024 |
| 1131616 | 1803 | 1822 | 7191 | 7210 | ACCACAGCCCGATCCCCAGC | 39 | 1025 |
| 1131644 | 1850 | 1869 | 7238 | 7257 | GCCAGGTAGTAGGCCACATC | 34 | 1026 |
| 1131672 | 1883 | 1902 | 7271 | 7290 | AGCAATCAGGAAACGGTGTG | 24 | 1027 |

TABLE 17-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131700 | 1927 | 1946 | 7315 | 7334 | CTCTCTCACTGCGGAATCAC | 7 | 1028 |
| 1131728 | 1963 | 1982 | 7351 | 7370 | GAATGGGACACAATCTTGCC | 21 | 1029 |
| 1131756 | 2017 | 2036 | 7405 | 7424 | AAGCACTTTATTGAGTTCCT | 5 | 1030 |
| 1131784 | N/A | N/A | 124 | 143 | ACAATCCTGGGACAATCCTG | 85 | 1031 |
| 1131812 | N/A | N/A | 208 | 227 | TTTCCACATAGGCCTCCTAG | 42 | 1032 |
| 1131840 | N/A | N/A | 311 | 330 | TCTTCTTAAGGCCCATCTCC | 79 | 1033 |
| 1131868 | N/A | N/A | 401 | 420 | GATCTGTTGCTAGTCTGCAG | 82 | 1034 |
| 1131896 | N/A | N/A | 529 | 548 | GGAGCCAGGCCACTTACCGA | 45 | 1035 |
| 1131924 | N/A | N/A | 636 | 655 | AGTGCCCATGGGCATAAGAC | 52 | 1036 |
| 1131952 | N/A | N/A | 739 | 758 | GCCAGCAGCACATATCTCAA | 55 | 1037 |
| 1131980 | N/A | N/A | 892 | 911 | TGCCAGAGACAAGCTCTTGA | 73 | 1038 |
| 1132008 | N/A | N/A | 1006 | 1025 | ACTGTTATCAACCTGGTTTC | 60 | 1039 |
| 1132036 | N/A | N/A | 1105 | 1124 | TTCATAATAAAAGCTAATAT | 68 | 1040 |
| 1132064 | N/A | N/A | 1521 | 1540 | ATGTGCCACACTCTAGGTAA | 51 | 1041 |
| 1132092 | N/A | N/A | 1622 | 1641 | CCAGGGTTGGAATGTGCTGG | 56 | 1042 |
| 1132120 | N/A | N/A | 1917 | 1936 | CTGAGCATGAAGTTGTGTGC | 44 | 1043 |
| 1132148 | N/A | N/A | 2166 | 2185 | AAGCTTTTGCCACTATTTTG | 36 | 1044 |
| 1132176 | N/A | N/A | 2283 | 2302 | ATAACCATCGCGAATAATGA | 50 | 1045 |
| 1132204 | N/A | N/A | 2397 | 2416 | AATCATACATAAAACCAGAT | 75 | 1046 |
| 1132232 | N/A | N/A | 2536 | 2555 | GTGTAGTTCCTAAGCACAAG | 37 | 1047 |
| 1132260 | N/A | N/A | 2658 | 2677 | TTCAGCTCTCCTATTGAATG | 37 | 1048 |
| 1132288 | N/A | N/A | 2771 | 2790 | CCAAGTCAATACTTGAAATG | 42 | 1049 |
| 1132316 | N/A | N/A | 2863 | 2882 | TAAAACGGCAGTAATAATAG | 62 | 1050 |
| 1132344 | N/A | N/A | 2974 | 2993 | CAGTCCCAAGGCCAGGAAGA | 38 | 1051 |
| 1132372 | N/A | N/A | 3382 | 3401 | AAACACTTTCTGCTCTAAAA | 67 | 1052 |
| 1132400 | N/A | N/A | 3469 | 3488 | CTTCCCCTGTACTCAACTGC | 43 | 1053 |
| 1132428 | N/A | N/A | 3667 | 3686 | TCCTTGGACAGAAGGACAGG | 75 | 1054 |
| 1132456 | N/A | N/A | 3833 | 3852 | TGTGTAGCACCTTTCACTTT | 41 | 1055 |
| 1132484 | N/A | N/A | 3957 | 3976 | ACTTCCAAAGGGTATTGTGG | 56 | 1056 |
| 1132512 | N/A | N/A | 4045 | 4064 | TGCCTTGTGACCTTGCTACT | 34 | 1057 |
| 1132540 | N/A | N/A | 4245 | 4264 | ATCTCCTCACCTTTCTGGCA | 82 | 1058 |
| 1132568 | N/A | N/A | 4346 | 4365 | CAGGAGAGTCTAGGACCATG | 78 | 1059 |
| 1132596 | N/A | N/A | 4578 | 4597 | GGCACACCACCCGGCCTCCT | 48 | 1060 |
| 1132624 | N/A | N/A | 4778 | 4797 | GCCTTCTGCTTGCCCCAGAC | 48 | 1061 |
| 1132652 | N/A | N/A | 4911 | 4930 | AGCAGCTTGCCTTGGTGTCT | 25 | 1062 |

TABLE 17-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132680 | N/A | N/A | 5427 | 5446 | GGCTGGCCGGAATCTAGCTC | 69 | 1063 |
| 1132708 | N/A | N/A | 5853 | 5872 | TGTTCCAGCTTCCTCCCCGG | 37 | 1064 |
| 1132736 | N/A | N/A | 6315 | 6334 | GTTGTGCCTACCCTCGAACT | 85 | 1065 |
| 1132764 | N/A | N/A | 6406 | 6425 | TCTGTAGGCACCCGGAACGA | 58 | 1066 |
| 1132792 | N/A | N/A | 6527 | 6546 | AGTTCGATTCTCCCTGTATC | 54 | 1067 |
| 1132820 | N/A | N/A | 6652 | 6671 | AAACAGAAACCCCTCCCCCA | 73 | 1068 |
| 1132848 | N/A | N/A | 6758 | 6777 | TCCTCTCTCGCAGCAAGCCC | 57 | 1069 |
| 1132876 | N/A | N/A | 7013 | 7032 | CTCACCTGGCACGCATCGGT | 64† | 1070 |

TABLE 18

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130749 | 12 | 31 | 12 | 31 | CAGCTGCCTATCCAGGAGTC | 57 | 1071 |
| 1130777 | 49 | 68 | 49 | 68 | GGAGCAGCAGAGCCCTCATG | 40 | 1072 |
| 1130805 | 96 | 115 | N/A | N/A | AGGTGGAATCGAAAGTGTTG | 34 | 1073 |
| 1130833 | 151 | 170 | N/A | N/A | TGAGAACGACTGTGTGCTCT | 27 | 1074 |
| 1130861 | 205 | 224 | 3556 | 3575 | GGTACAGCTGCCGGTGGTAC | 31 | 1075 |
| 1130871 | 216 | 235 | 3567 | 3586 | GGTACATTTGTGGTACAGCT | 10 | 183 |
| 1130890 | 240 | 259 | 3591 | 3610 | CTGAGGGCCTGGCCGGCCCT | 40 | 1076 |
| 1130918 | 310 | 329 | 3817 | 3836 | CTTTCTTGGGCTCCAAACAG | 36 | 1077 |
| 1130946 | 366 | 385 | 4174 | 4193 | GTTCACACAGGTCCCTCCTT | 48 | 1078 |
| 1130974 | 423 | 442 | 4231 | 4250 | CTGGCAGTGGTTTCCAGTGA | 28 | 1079 |
| 1131002 | 464 | 483 | 4409 | 4428 | TGGAAAAACCGGAGAAGCTG | 22 | 1080 |
| 1131030 | 508 | 527 | 4453 | 4472 | TGGCCACAGCTGCTTGCTCA | 48 | 1081 |
| 1131058 | 547 | 566 | 4492 | 4511 | GCCGCTGGCAGTGGGCATCA | 42 | 1082 |
| 1131086 | 583 | 602 | 4667 | 4686 | GGAGGCACGGGTTGGTGCGG | 27 | 1083 |
| 1131114 | 622 | 641 | 4706 | 4725 | ACAGGCGGTGGCCCTCCACC | 58 | 1084 |
| 1131142 | 685 | 704 | 4914 | 4933 | CATAGCAGCTTGCCTTGGTG | 22 | 1085 |
| 1131170 | 724 | 743 | 4953 | 4972 | TGGTCCTGGCCAGGCCGCGG | 77 | 1086 |
| 1131198 | 796 | 815 | 5025 | 5044 | GCGCTTGCTCGGCAGTCACG | 18 | 1087 |
| 1131226 | 873 | 892 | 5187 | 5206 | GTTCAGCACGAAGCACCACG | 21 | 1088 |
| 1131254 | 916 | 935 | 5230 | 5249 | GGCACTGTGCCAGGTCGCAG | 39 | 1089 |

TABLE 18-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131282 | 1007 | 1026 | 5321 | 5340 | TGAGGCTTCGGCGGTGCCGG | 43 | 1090 |
| 1131310 | 1089 | 1108 | 5508 | 5527 | CCTGGTCAGGGAAGGCGGCT | 27 | 1091 |
| 1131338 | 1131 | 1150 | 5550 | 5569 | CAGACTCTTGCGGAGCCGCT | 22 | 1092 |
| 1131366 | 1203 | 1222 | 5622 | 5641 | GTACAGCGCGGCGATGTAGG | 41 | 1093 |
| 1131394 | 1239 | 1258 | 5658 | 5677 | GGCGATGAGGCTGCCGGCGC | 31 | 114 |
| 1131422 | 1341 | 1360 | 6001 | 6020 | CTCACAGCTGTGGTTACGGC | 23 | 1094 |
| 1131450 | 1433 | 1452 | N/A | N/A | TGAAGGCGCAACAGAGCCAG | 46 | 1095 |
| 1131478 | 1492 | 1511 | 6235 | 6254 | GCAGGCACACCGGCTGAACG | 36 | 72 |
| 1131506 | 1560 | 1579 | 6303 | 6322 | CTCGAACTGGTGGCCCCAGC | 53 | 1096 |
| 1131534 | 1597 | 1616 | 6895 | 6914 | GCGCCTCCTGCAGGAAGCTG | 92 | 1097 |
| 1131562 | 1690 | 1709 | 6988 | 7007 | CCTCGAGGAACCCTGCGCAG | 27† | 1098 |
| 1131590 | 1776 | 1795 | 7164 | 7183 | GCCTTGCAGGGTGAGCCGGC | 43 | 1099 |
| 1131618 | 1805 | 1824 | 7193 | 7212 | TCACCACAGCCCGATCCCCA | 40 | 1100 |
| 1131646 | 1852 | 1871 | 7240 | 7259 | AGGCCAGGTAGTAGGCCACA | 63 | 1101 |
| 1131674 | 1888 | 1907 | 7276 | 7295 | CCCTGAGCAATCAGGAAACG | 35 | 1102 |
| 1131702 | 1930 | 1949 | 7318 | 7337 | CCACTCTCTCACTGCGGAAT | 9 | 1103 |
| 1131730 | 1984 | 2003 | 7372 | 7391 | GCGGAGCTGGCCGCACTGGG | 18 | 1104 |
| 1131758 | 2019 | 2038 | 7407 | 7426 | CAAAGCACTTTATTGAGTTC | 9 | 1105 |
| 1131786 | N/A | N/A | 130 | 149 | CCCAGAACAATCCTGGGACA | 70 | 1106 |
| 1131814 | N/A | N/A | 214 | 233 | CTCACCTTTCCACATAGGCC | 82 | 1107 |
| 1131842 | N/A | N/A | 317 | 336 | CCGTTGTCTTCTTAAGGCCC | 82 | 1108 |
| 1131870 | N/A | N/A | 407 | 426 | GCCACCGATCTGTTGCTAGT | 67 | 1109 |
| 1131898 | N/A | N/A | 538 | 557 | CCGGGAGGAGGAGCCAGGCC | 67 | 1110 |
| 1131926 | N/A | N/A | 642 | 661 | CACTCTAGTGCCCATGGGCA | 83 | 1111 |
| 1131954 | N/A | N/A | 760 | 779 | CAGGAGCCCAGGTGTGATGG | 47 | 1112 |
| 1131982 | N/A | N/A | 898 | 917 | TTCAGATGCCAGAGACAAGC | 54 | 1113 |
| 1132010 | N/A | N/A | 1012 | 1031 | AGGTTTACTGTTATCAACCT | 48 | 1114 |
| 1132038 | N/A | N/A | 1111 | 1130 | GGTAGTTTCATAATAAAAGC | 36 | 1115 |
| 1132066 | N/A | N/A | 1527 | 1546 | CCTGCTATGTGCCACACTCT | 59 | 1116 |
| 1132094 | N/A | N/A | 1637 | 1656 | GGAGGCTGAGGGAGTCCAGG | 90 | 1117 |
| 1132122 | N/A | N/A | 1923 | 1942 | AATTAGCTGAGCATGAAGTT | 54 | 1118 |
| 1132150 | N/A | N/A | 2172 | 2191 | CTCAATAAGCTTTTGCCACT | 57 | 1119 |
| 1132178 | N/A | N/A | 2289 | 2308 | TAGAACATAACCATCGCGAA | 33 | 1120 |
| 1132206 | N/A | N/A | 2411 | 2430 | ATGTCTTTAAACAGAATCAT | 32 | 1121 |
| 1132234 | N/A | N/A | 2542 | 2561 | AGAGCTGTGTAGTTCCTAAG | 65 | 1122 |

TABLE 18-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132262 | N/A | N/A | 2664 | 2683 | GCTTGTTTCAGCTCTCCTAT | 78 | 1123 |
| 1132290 | N/A | N/A | 2777 | 2796 | TAACTCCCAAGTCAATACTT | 76 | 1124 |
| 1132318 | N/A | N/A | 2890 | 2909 | TGATCTGAGCCTTGGTTTCC | 69 | 1125 |
| 1132346 | N/A | N/A | 2980 | 2999 | AGTCTTCAGTCCCAAGGCCA | 71 | 1126 |
| 1132374 | N/A | N/A | 3388 | 3407 | CATTGAAAACACTTTCTGCT | 70 | 1127 |
| 1132402 | N/A | N/A | 3475 | 3494 | TGAGGACTTCCCCTGTACTC | 40 | 1128 |
| 1132430 | N/A | N/A | 3673 | 3692 | CAGAGTTCCTTGGACAGAAG | 38 | 1129 |
| 1132458 | N/A | N/A | 3839 | 3858 | AGGCTGTGTGTAGCACCTTT | 54 | 1130 |
| 1132486 | N/A | N/A | 3963 | 3982 | CTCTGGACTTCCAAAGGGTA | 37 | 1131 |
| 1132514 | N/A | N/A | 4051 | 4070 | CCTACTTGCCTTGTGACCTT | 37 | 1132 |
| 1132542 | N/A | N/A | 4251 | 4270 | CTCCACATCTCCTCACCTTT | 39 | 1133 |
| 1132570 | N/A | N/A | 4352 | 4371 | TGGTCTCAGGAGAGTCTAGG | 59 | 1134 |
| 1132598 | N/A | N/A | 4584 | 4603 | CTTCCTGGCACACCACCCGG | 60 | 1135 |
| 1132626 | N/A | N/A | 4784 | 4803 | GGGCTGGCCTTCTGCTTGCC | 36 | 1136 |
| 1132654 | N/A | N/A | 5070 | 5089 | ACGCGGCGCACCGGCAGAAG | 61 | 1137 |
| 1132682 | N/A | N/A | 5436 | 5455 | CCCGCGGCCGGCTGGCCGGA | 118 | 1138 |
| 1132710 | N/A | N/A | 5859 | 5878 | ATCCCGTGTTCCAGCTTCCT | 67 | 1139 |
| 1132738 | N/A | N/A | 6321 | 6340 | CTAGCAGTTGTGCCTACCCT | 49 | 1140 |
| 1132766 | N/A | N/A | 6412 | 6431 | ACCCATTCTGTAGGCACCCG | 78 | 1141 |
| 1132794 | N/A | N/A | 6533 | 6552 | AGAGCAAGTTCGATTCTCCC | 88 | 1142 |
| 1132822 | N/A | N/A | 6658 | 6677 | GAGCGGAAACAGAAACCCCT | 52 | 1143 |
| 1132850 | N/A | N/A | 6764 | 6783 | TGCCCTTCCTCTCTCGCAGC | 95 | 1144 |
| 1132878 | N/A | N/A | 7019 | 7038 | TAAGAGCTCACCTGGCACGC | 85† | 1145 |

TABLE 19

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130748 | 11 | 30 | 11 | 30 | AGCTGCCTATCCAGGAGTCC | 62 | 1146 |
| 1130776 | 48 | 67 | 48 | 67 | GAGCAGCAGAGCCCTCATGG | 67 | 1147 |
| 1130804 | 94 | 113 | N/A | N/A | GTGGAATCGAAAGTGTTGAC | 58 | 1148 |
| 1130832 | 150 | 169 | N/A | N/A | GAGAACGACTGTGTGCTCTT | 12 | 1149 |

TABLE 19-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130860 | 204 | 223 | 3555 | 3574 | GTACAGCTGCCGGTGGTACT | 35 | 1150 |
| 1130871 | 216 | 235 | 3567 | 3586 | GGTACATTTGTGGTACAGCT | 16 | 183 |
| 1130889 | 239 | 258 | 3590 | 3609 | TGAGGGCCTGGCCGGCCCTT | 54 | 1151 |
| 1130917 | 308 | 327 | 3815 | 3834 | TTCTTGGGCTCCAAACAGTA | 25 | 1152 |
| 1130945 | 365 | 384 | 4173 | 4192 | TTCACACAGGTCCCTCCTTT | 37 | 1153 |
| 1130973 | 421 | 440 | 4229 | 4248 | GGCAGTGGTTTCCAGTGAGG | 14 | 1154 |
| 1131001 | 463 | 482 | 4408 | 4427 | GGAAAAACCGGAGAAGCTGA | 26 | 1155 |
| 1131029 | 506 | 525 | 4451 | 4470 | GCCACAGCTGCTTGCTCAGT | 35 | 1156 |
| 1131057 | 546 | 565 | 4491 | 4510 | CCGCTGGCAGTGGGCATCAG | 32 | 1157 |
| 1131085 | 582 | 601 | 4666 | 4685 | GAGGCACGGGTTGGTGCGGC | 32 | 1158 |
| 1131113 | 621 | 640 | 4705 | 4724 | CAGGCGGTGGCCCTCCACCT | 25 | 1159 |
| 1131141 | 682 | 701 | N/A | N/A | AGCAGCTTGCCTTGGTGTCC | 29 | 1160 |
| 1131169 | 722 | 741 | 4951 | 4970 | GTCCTGGCCAGGCCGCGGTA | 42 | 1161 |
| 1131197 | 778 | 797 | 5007 | 5026 | CGTTCCGGTAGGTGGCCTCC | 28 | 1162 |
| 1131225 | 872 | 891 | 5186 | 5205 | TTCAGCACGAAGCACCACGG | 27 | 1163 |
| 1131253 | 915 | 934 | 5229 | 5248 | GCACTGTGCCAGGTCGCAGT | 36 | 1164 |
| 1131281 | 1006 | 1025 | 5320 | 5339 | GAGGCTTCGGCGGTGCCGGC | 26 | 1165 |
| 1131309 | 1087 | 1106 | 5506 | 5525 | TGGTCAGGGAAGGCGGCTGC | 8 | 1166 |
| 1131337 | 1130 | 1149 | 5549 | 5568 | AGACTCTTGCGGAGCCGCTG | 24 | 1167 |
| 1131365 | 1168 | 1187 | 5587 | 5606 | GCGCCACCAGCCCGCCAACG | 33 | 1168 |
| 1131393 | 1238 | 1257 | 5657 | 5676 | GCGATGAGGCTGCCGGCGCA | 26 | 1169 |
| 1131421 | 1340 | 1359 | 6000 | 6019 | TCACAGCTGTGGTTACGGCG | 38 | 1170 |
| 1131449 | 1431 | 1450 | N/A | N/A | AAGGCGCAACAGAGCCAGGT | 55 | 1171 |
| 1131477 | 1474 | 1493 | 6217 | 6236 | CGTAAGGCGACAGGAGCGCG | 25 | 1172 |
| 1131505 | 1559 | 1578 | 6302 | 6321 | TCGAACTGGTGGCCCCAGCC | 86 | 74 |
| 1131533 | 1595 | 1614 | 6893 | 6912 | GCCTCCTGCAGGAAGCTGGC | 53 | 1173 |
| 1131561 | 1688 | 1707 | 6986 | 7005 | TCGAGGAACCCTGCGCAGAG | 21† | 1174 |
| 1131589 | 1775 | 1794 | 7163 | 7182 | CCTTGCAGGGTGAGCCGGCG | 30 | 1175 |
| 1131617 | 1804 | 1823 | 7192 | 7211 | CACCACAGCCCGATCCCCAG | 28 | 1176 |
| 1131645 | 1851 | 1870 | 7239 | 7258 | GGCCAGGTAGTAGGCCACAT | 63 | 1177 |
| 1131673 | 1886 | 1905 | 7274 | 7293 | CTGAGCAATCAGGAAACGGT | 16 | 1178 |
| 1131701 | 1928 | 1947 | 7316 | 7335 | ACTCTCTCACTGCGGAATCA | 7 | 1179 |
| 1131729 | 1964 | 1983 | 7352 | 7371 | GGAATGGGACACAATCTTGC | 26 | 1180 |
| 1131757 | 2018 | 2037 | 7406 | 7425 | AAAGCACTTTATTGAGTTCC | 3 | 165 |
| 1131785 | N/A | N/A | 127 | 146 | AGAACAATCCTGGGACAATC | 69 | 1181 |

TABLE 19-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131813 | N/A | N/A | 211 | 230 | ACCTTTCCACATAGGCCTCC | 99 | 1182 |
| 1131841 | N/A | N/A | 314 | 333 | TTGTCTTCTTAAGGCCCATC | 49 | 1183 |
| 1131869 | N/A | N/A | 404 | 423 | ACCGATCTGTTGCTAGTCTG | 72 | 1184 |
| 1131897 | N/A | N/A | 535 | 554 | GGAGGAGGAGCCAGGCCACT | 94 | 1185 |
| 1131925 | N/A | N/A | 639 | 658 | TCTAGTGCCCATGGGCATAA | 38 | 1186 |
| 1131953 | N/A | N/A | 757 | 776 | GAGCCCAGGTGTGATGGCGC | 87 | 1187 |
| 1131981 | N/A | N/A | 895 | 914 | AGATGCCAGAGACAAGCTCT | 49 | 1188 |
| 1132009 | N/A | N/A | 1009 | 1028 | TTTACTGTTATCAACCTGGT | 38 | 1189 |
| 1132037 | N/A | N/A | 1108 | 1127 | AGTTTCATAATAAAAGCTAA | 83 | 1190 |
| 1132065 | N/A | N/A | 1524 | 1543 | GCTATGTGCCACACTCTAGG | 102 | 1191 |
| 1132093 | N/A | N/A | 1625 | 1644 | AGTCCAGGGTTGGAATGTGC | 80 | 1192 |
| 1132121 | N/A | N/A | 1920 | 1939 | TAGCTGAGCATGAAGTTGTG | 52 | 1193 |
| 1132149 | N/A | N/A | 2169 | 2188 | AATAAGCTTTTGCCACTATT | 59 | 1194 |
| 1132177 | N/A | N/A | 2286 | 2305 | AACATAACCATCGCGAATAA | 53 | 1195 |
| 1132205 | N/A | N/A | 2400 | 2419 | CAGAATCATACATAAAACCA | 45 | 1196 |
| 1132233 | N/A | N/A | 2539 | 2558 | GCTGTGTAGTTCCTAAGCAC | 70 | 1197 |
| 1132261 | N/A | N/A | 2661 | 2680 | TGTTTCAGCTCTCCTATTGA | 53 | 1198 |
| 1132289 | N/A | N/A | 2774 | 2793 | CTCCCAAGTCAATACTTGAA | 93 | 1199 |
| 1132317 | N/A | N/A | 2870 | 2889 | TTATCTGTAAAACGGCAGTA | 38 | 1200 |
| 1132345 | N/A | N/A | 2977 | 2996 | CTTCAGTCCCAAGGCCAGGA | 64 | 1201 |
| 1132373 | N/A | N/A | 3385 | 3404 | TGAAAACACTTTCTGCTCTA | 51 | 1202 |
| 1132401 | N/A | N/A | 3472 | 3491 | GGACTTCCCCTGTACTCAAC | 72 | 1203 |
| 1132429 | N/A | N/A | 3670 | 3689 | AGTTCCTTGGACAGAAGGAC | 50 | 1204 |
| 1132457 | N/A | N/A | 3836 | 3855 | CTGTGTGTAGCACCTTTCAC | 73 | 1205 |
| 1132485 | N/A | N/A | 3960 | 3979 | TGGACTTCCAAAGGGTATTG | 39 | 1206 |
| 1132513 | N/A | N/A | 4048 | 4067 | ACTTGCCTTGTGACCTTGCT | 58 | 1207 |
| 1132541 | N/A | N/A | 4248 | 4267 | CACATCTCCTCACCTTTCTG | 98 | 1208 |
| 1132569 | N/A | N/A | 4349 | 4368 | TCTCAGGAGAGTCTAGGACC | 59 | 1209 |
| 1132597 | N/A | N/A | 4581 | 4600 | CCTGGCACACCACCCGGCCT | 70 | 1210 |
| 1132625 | N/A | N/A | 4781 | 4800 | CTGGCCTTCTGCTTGCCCCA | 46 | 1211 |
| 1132653 | N/A | N/A | 5067 | 5086 | CGGCGCACCGGCAGAAGGCG | 37 | 1212 |
| 1132681 | N/A | N/A | 5430 | 5449 | GCCGGCTGGCCGGAATCTAG | 77 | 1213 |
| 1132709 | N/A | N/A | 5856 | 5875 | CCGTGTTCCAGCTTCCTCCC | 160 | 1214 |
| 1132737 | N/A | N/A | 6318 | 6337 | GCAGTTGTGCCTACCCTCGA | 49 | 1215 |
| 1132765 | N/A | N/A | 6409 | 6428 | CATTCTGTAGGCACCCGGAA | 47 | 1216 |

TABLE 19-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132793 | N/A | N/A | 6530 | 6549 | GCAAGTTCGATTCTCCCTGT | 72 | 1217 |
| 1132821 | N/A | N/A | 6655 | 6674 | CGGAAACAGAAACCCCTCCC | 47 | 1218 |
| 1132849 | N/A | N/A | 6761 | 6780 | CCTTCCTCTCTCGCAGCAAG | 59 | 1219 |
| 1132877 | N/A | N/A | 7016 | 7035 | GAGCTCACCTGGCACGCATC | 85† | 1220 |

TABLE 20

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130750 | 13 | 32 | 13 | 32 | CCAGCTGCCTATCCAGGAGT | 48 | 1221 |
| 1130778 | 50 | 69 | 50 | 69 | AGGAGCAGCAGAGCCCTCAT | 38 | 1222 |
| 1130806 | 97 | 116 | N/A | N/A | AAGGTGGAATCGAAAGTGTT | 67 | 1223 |
| 1130834 | 152 | 171 | N/A | N/A | GTGAGAACGACTGTGTGCTC | 20 | 1224 |
| 1130862 | 206 | 225 | 3557 | 3576 | TGGTACAGCTGCCGGTGGTA | 26 | 1225 |
| 1130871 | 216 | 235 | 3567 | 3586 | GGTACATTTGTGGTACAGCT | 13 | 183 |
| 1130891 | 241 | 260 | 3592 | 3611 | GCTGAGGGCCTGGCCGGCCC | 51 | 1226 |
| 1130919 | 311 | 330 | 3818 | 3837 | ACTTTCTTGGGCTCCAAACA | 49 | 1227 |
| 1130947 | 367 | 386 | 4175 | 4194 | TGTTCACACAGGTCCCTCCT | 28 | 1228 |
| 1130975 | 426 | 445 | 4234 | 4253 | TTTCTGGCAGTGGTTTCCAG | 24 | 1229 |
| 1131003 | 469 | 488 | 4414 | 4433 | TCTTGTGGAAAAACCGGAGA | 36 | 1230 |
| 1131031 | 509 | 528 | 4454 | 4473 | CTGGCCACAGCTGCTTGCTC | 46 | 1231 |
| 1131059 | 549 | 568 | 4494 | 4513 | CAGCCGCTGGCAGTGGGCAT | 71 | 1232 |
| 1131087 | 585 | 604 | 4669 | 4688 | ATGGAGGCACGGGTTGGTGC | 64 | 1233 |
| 1131115 | 624 | 643 | 4708 | 4727 | GCACAGGCGGTGGCCCTCCA | 34 | 1234 |
| 1131143 | 686 | 705 | 4915 | 4934 | TCATAGCAGCTTGCCTTGGT | 28 | 1235 |
| 1131171 | 725 | 744 | 4954 | 4973 | GTGGTCCTGGCCAGGCCGCG | 64 | 1236 |
| 1131199 | 797 | 816 | 5026 | 5045 | CGCGCTTGCTCGGCAGTCAC | 17 | 1237 |
| 1131227 | 874 | 893 | 5188 | 5207 | GGTTCAGCACGAAGCACCAC | 23 | 1238 |
| 1131255 | 917 | 936 | 5231 | 5250 | TGGCACTGTGCCAGGTCGCA | 18 | 1239 |
| 1131283 | 1008 | 1027 | 5322 | 5341 | CTGAGGCTTCGGCGGTGCCG | 21 | 1240 |
| 1131311 | 1090 | 1109 | 5509 | 5528 | TCCTGGTCAGGGAAGGCGGC | 26 | 1241 |
| 1131339 | 1132 | 1151 | 5551 | 5570 | ACAGACTCTTGCGGAGCCGC | 20 | 60 |
| 1131367 | 1204 | 1223 | 5623 | 5642 | AGTACAGCGCGGCGATGTAG | 42 | 1242 |

TABLE 20-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131395 | 1240 | 1259 | 5659 | 5678 | GGGCGATGAGGCTGCCGGCG | 53 | 1243 |
| 1131423 | 1342 | 1361 | 6002 | 6021 | GCTCACAGCTGTGGTTACGG | 19 | 1244 |
| 1131451 | 1434 | 1453 | N/A | N/A | CTGAAGGCGCAACAGAGCCA | 46 | 1245 |
| 1131479 | 1493 | 1512 | 6236 | 6255 | GGCAGGCACACCGGCTGAAC | 31 | 1246 |
| 1131507 | 1561 | 1580 | 6304 | 6323 | CCTCGAACTGGTGGCCCCAG | 153 | 1247 |
| 1131535 | 1598 | 1617 | 6896 | 6915 | TGCGCCTCCTGCAGGAAGCT | 116 | 1248 |
| 1131563 | 1691 | 1710 | 6989 | 7008 | CCCTCGAGGAACCCTGCGCA | 23† | 1249 |
| 1131591 | 1777 | 1796 | 7165 | 7184 | TGCCTTGCAGGGTGAGCCGG | 19 | 1250 |
| 1131619 | 1806 | 1825 | 7194 | 7213 | GTCACCACAGCCCGATCCCC | 37 | 1251 |
| 1131647 | 1853 | 1872 | 7241 | 7260 | CAGGCCAGGTAGTAGGCCAC | 48 | 1252 |
| 1131675 | 1893 | 1912 | 7281 | 7300 | TGAGTCCCTGAGCAATCAGG | 19 | 150 |
| 1131703 | 1932 | 1951 | 7320 | 7339 | AGCCACTCTCTCACTGCGGA | 24 | 1253 |
| 1131731 | 1985 | 2004 | 7373 | 7392 | CGCGGAGCTGGCCGCACTGG | 30 | 1254 |
| 1131759 | 2020 | 2039 | 7408 | 7427 | TCAAAGCACTTTATTGAGTT | 11 | 1255 |
| 1131787 | N/A | N/A | 133 | 152 | CCCCCCAGAACAATCCTGGG | 80 | 1256 |
| 1131815 | N/A | N/A | 217 | 236 | GGCCTCACCTTTCCACATAG | 66 | 1257 |
| 1131843 | N/A | N/A | 320 | 339 | CCCCCGTTGTCTTCTTAAGG | 47 | 1258 |
| 1131871 | N/A | N/A | 410 | 429 | CCTGCCACCGATCTGTTGCT | 124 | 1259 |
| 1131899 | N/A | N/A | 541 | 560 | TTCCCGGGAGGAGGAGCCAG | 46 | 1260 |
| 1131927 | N/A | N/A | 645 | 664 | GATCACTCTAGTGCCCATGG | 48 | 1261 |
| 1131955 | N/A | N/A | 763 | 782 | TGGCAGGAGCCCAGGTGTGA | 66 | 1262 |
| 1131983 | N/A | N/A | 901 | 920 | GCATTCAGATGCCAGAGACA | 77 | 1263 |
| 1132011 | N/A | N/A | 1015 | 1034 | AAGAGGTTTACTGTTATCAA | 55 | 1264 |
| 1132039 | N/A | N/A | 1114 | 1133 | AAAGGTAGTTTCATAATAAA | 44 | 1265 |
| 1132067 | N/A | N/A | 1530 | 1549 | GGCCCTGCTATGTGCCACAC | 93 | 1266 |
| 1132095 | N/A | N/A | 1640 | 1659 | AGAGGAGGCTGAGGGAGTCC | 52 | 1267 |
| 1132123 | N/A | N/A | 2075 | 2094 | ACCTTTAAGATGCAAATGGG | 51 | 1268 |
| 1132151 | N/A | N/A | 2175 | 2194 | CTGCTCAATAAGCTTTTGCC | 54 | 1269 |
| 1132179 | N/A | N/A | 2292 | 2311 | TTATAGAACATAACCATCGC | 68 | 1270 |
| 1132207 | N/A | N/A | 2426 | 2445 | CATATACTAAATAAAATGTC | 99 | 1271 |
| 1132235 | N/A | N/A | 2545 | 2564 | TGAAGAGCTGTGTAGTTCCT | 58 | 1272 |
| 1132263 | N/A | N/A | 2667 | 2686 | GCTGCTTGTTTCAGCTCTCC | 55 | 1273 |
| 1132291 | N/A | N/A | 2780 | 2799 | TTGTAACTCCCAAGTCAATA | 78 | 1274 |
| 1132319 | N/A | N/A | 2893 | 2912 | CTCTGATCTGAGCCTTGGTT | 95 | 1275 |
| 1132347 | N/A | N/A | 2983 | 3002 | GTAAGTCTTCAGTCCCAAGG | 86 | 1276 |

TABLE 20-continued

Reduction of FXII RNA by 5-10-5 MOE gapmers with mixed
PO/PS internucleoside linkages (Huh7, electroporation,
5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132375 | N/A | N/A | 3391 | 3410 | GTGCATTGAAAACACTTTCT | 41 | 1277 |
| 1132403 | N/A | N/A | 3478 | 3497 | CTCTGAGGACTTCCCCTGTA | 166 | 1278 |
| 1132431 | N/A | N/A | 3676 | 3695 | AAGCAGAGTTCCTTGGACAG | 57 | 1279 |
| 1132459 | N/A | N/A | 3842 | 3861 | CAGAGGCTGTGTGTAGCACC | 76 | 1280 |
| 1132487 | N/A | N/A | 3966 | 3985 | TCCCTCTGGACTTCCAAAGG | 47 | 1281 |
| 1132515 | N/A | N/A | 4054 | 4073 | GAACCTACTTGCCTTGTGAC | 59 | 1282 |
| 1132543 | N/A | N/A | 4254 | 4273 | GTCCTCCACATCTCCTCACC | 47 | 1283 |
| 1132571 | N/A | N/A | 4355 | 4374 | TAGTGGTCTCAGGAGAGTCT | 92 | 1284 |
| 1132599 | N/A | N/A | 4587 | 4606 | CTCCTTCCTGGCACACCACC | 38 | 1285 |
| 1132627 | N/A | N/A | 4803 | 4822 | GCAAGCCCGTCCCACCTGGG | 47 | 1286 |
| 1132655 | N/A | N/A | 5073 | 5092 | CCCACGCGGCGCACCGGCAG | 48 | 1287 |
| 1132683 | N/A | N/A | 5439 | 5458 | GAGCCCGCGGCCGGCTGGCC | 68 | 1288 |
| 1132711 | N/A | N/A | 5862 | 5881 | CCAATCCCGTGTTCCAGCTT | 37 | 1289 |
| 1132739 | N/A | N/A | 6324 | 6343 | CCCCTAGCAGTTGTGCCTAC | 138 | 1290 |
| 1132767 | N/A | N/A | 6415 | 6434 | GCCACCCATTCTGTAGGCAC | 59 | 1291 |
| 1132795 | N/A | N/A | 6536 | 6555 | CCAAGAGCAAGTTCGATTCT | 50 | 1292 |
| 1132823 | N/A | N/A | 6661 | 6680 | GCGGAGCGGAAACAGAAACC | 88 | 1293 |
| 1132851 | N/A | N/A | 6767 | 6786 | TCATGCCCTTCCTCTCTCGC | 39 | 1294 |
| 1132879 | N/A | N/A | 7025 | 7044 | CCGGGCTAAGAGCTCACCTG | 59† | 1295 |

TABLE 21

Reduction of FXII RNA by 5-10-5 MOE gapmers with mixed
PO/PS internucleoside linkages (Huh7, electroporation,
5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130752 | 15 | 34 | 15 | 34 | GTCCAGCTGCCTATCCAGGA | 49 | 1296 |
| 1130780 | 57 | 76 | 57 | 76 | GAACCCCAGGAGCAGCAGAG | 72 | 1297 |
| 1130808 | 103 | 122 | N/A | N/A | CTTCCCAAGGTGGAATCGAA | 62 | 1298 |
| 1130836 | 154 | 173 | N/A | N/A | CAGTGAGAACGACTGTGTGC | 41 | 1299 |
| 1130864 | 208 | 227 | 3559 | 3578 | TGTGGTACAGCTGCCGGTGG | 42 | 1300 |
| 1130871 | 216 | 235 | 3567 | 3586 | GGTACATTTGTGGTACAGCT | 21 | 183 |
| 1130893 | 254 | 273 | N/A | N/A | GTAGCACACCAGGGCTGAGG | 54 | 1301 |
| 1130921 | 313 | 332 | 3820 | 3839 | TCACTTTCTTGGGCTCCAAA | 41 | 1302 |

TABLE 21-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
| --- | --- | --- | --- | --- | --- | --- | --- |
| 1130949 | 371 | 390 | 4179 | 4198 | GGCATGTTCACACAGGTCCC | 42 | 1303 |
| 1130977 | 428 | 447 | N/A | N/A | TCTTTCTGGCAGTGGTTTCC | 48 | 1304 |
| 1131005 | 471 | 490 | 4416 | 4435 | ATTCTTGTGGAAAAACCGGA | 39 | 1305 |
| 1131033 | 511 | 530 | 4456 | 4475 | ATCTGGCCACAGCTGCTTGC | 53 | 1306 |
| 1131061 | 551 | 570 | 4496 | 4515 | GCCAGCCGCTGGCAGTGGGC | 58 | 1307 |
| 1131089 | 588 | 607 | 4672 | 4691 | CCCATGGAGGCACGGGTTGG | 40 | 1308 |
| 1131117 | 627 | 646 | 4711 | 4730 | GTGGCACAGGCGGTGGCCCT | 71 | 1309 |
| 1131145 | 690 | 709 | 4919 | 4938 | GCCATCATAGCAGCTTGCCT | 36 | 1310 |
| 1131173 | 745 | 764 | 4974 | 4993 | GACAGGGCGCACCCGAGAGC | 52 | 1311 |
| 1131201 | 799 | 818 | 5028 | 5047 | TCCGCGCTTGCTCGGCAGTC | 74 | 1312 |
| 1131229 | 882 | 901 | 5196 | 5215 | CCGGTCGCGGTTCAGCACGA | 46 | 1313 |
| 1131257 | 920 | 939 | 5234 | 5253 | GTCTGGCACTGTGCCAGGTC | 74 | 1314 |
| 1131285 | 1011 | 1030 | 5325 | 5344 | GGGCTGAGGCTTCGGCGGTG | 31 | 1315 |
| 1131313 | 1092 | 1111 | 5511 | 5530 | GTTCCTGGTCAGGGAAGGCG | 52 | 1316 |
| 1131341 | 1134 | 1153 | 5553 | 5572 | AGACAGACTCTTGCGGAGCC | 37 | 1317 |
| 1131369 | 1207 | 1226 | 5626 | 5645 | CCCAGTACAGCGCGGCGATG | 32 | 1318 |
| 1131397 | 1281 | 1300 | 5700 | 5719 | CCGGTCCTGCAGGCAGTGAG | 59 | 1319 |
| 1131425 | 1345 | 1364 | 6005 | 6024 | ACGGCTCACAGCTGTGGTTA | 49 | 1320 |
| 1131453 | 1437 | 1456 | 6180 | 6199 | CTCCTGAAGGCGCAACAGAG | 66 | 1321 |
| 1131481 | 1496 | 1515 | 6239 | 6258 | CTTGGCAGGCACACCGGCTG | 24 | 1322 |
| 1131509 | 1564 | 1583 | N/A | N/A | CCCCCTCGAACTGGTGGCCC | 76 | 1323 |
| 1131537 | 1603 | 1622 | 6901 | 6920 | GTACCTGCGCCTCCTGCAGG | 126 | 1324 |
| 1131565 | 1696 | 1715 | 6994 | 7013 | TGCCGCCCTCGAGGAACCCT | 8† | 1325 |
| 1131593 | 1780 | 1799 | 7168 | 7187 | TGATGCCTTGCAGGGTGAGC | 17 | 1326 |
| 1131621 | 1808 | 1827 | 7196 | 7215 | CGGTCACCACAGCCCGATCC | 35 | 1327 |
| 1131649 | 1856 | 1875 | 7244 | 7263 | ATCCAGGCCAGGTAGTAGGC | 70 | 1328 |
| 1131677 | 1895 | 1914 | 7283 | 7302 | GATGAGTCCCTGAGCAATCA | 35 | 1329 |
| 1131705 | 1935 | 1954 | 7323 | 7342 | CCCAGCCACTCTCTCACTGC | 37 | 1330 |
| 1131733 | 1989 | 2008 | 7377 | 7396 | CTGGCGCGGAGCTGGCCGCA | 49 | 1331 |
| 1131761 | 2023 | 2042 | 7411 | 7430 | TTTTCAAAGCACTTTATTGA | 28 | 1332 |
| 1131789 | N/A | N/A | 139 | 158 | TAGCGACCCCCCAGAACAAT | 101 | 1333 |
| 1131817 | N/A | N/A | 223 | 242 | CGGGCTGGCCTCACCTTTCC | 74 | 1334 |
| 1131845 | N/A | N/A | 326 | 345 | TACCTCCCCCGTTGTCTTC | 105 | 1335 |
| 1131873 | N/A | N/A | 416 | 435 | TCATAGCCTGCCACCGATCT | 77 | 1336 |
| 1131901 | N/A | N/A | 560 | 579 | ACACATCCCCACCCAAGGGT | 61 | 1337 |

TABLE 21-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131929 | N/A | N/A | 651 | 670 | GCTCACGATCACTCTAGTGC | 44 | 1338 |
| 1131957 | N/A | N/A | 770 | 789 | GGAAGGCTGGCAGGAGCCCA | 81 | 1339 |
| 1131985 | N/A | N/A | 910 | 929 | GCTTCAGAGGCATTCAGATG | 84 | 1340 |
| 1132013 | N/A | N/A | 1021 | 1040 | AACCCTAAGAGGTTTACTGT | 105 | 1341 |
| 1132041 | N/A | N/A | 1120 | 1139 | CATCTAAAAGGTAGTTTCAT | 90 | 1342 |
| 1132069 | N/A | N/A | 1536 | 1555 | TTCACAGGCCCTGCTATGTG | 101 | 1343 |
| 1132097 | N/A | N/A | 1667 | 1686 | GGAGAAACTTTTGGGTGTGG | 86 | 1344 |
| 1132125 | N/A | N/A | 2081 | 2100 | AGATGGACCTTTAAGATGCA | 79 | 1345 |
| 1132153 | N/A | N/A | 2181 | 2200 | AAGTACCTGCTCAATAAGCT | 61 | 1346 |
| 1132181 | N/A | N/A | 2299 | 2318 | TGTGATTTTATAGAACATAA | 71 | 1347 |
| 1132209 | N/A | N/A | 2437 | 2456 | AATCAGCAACACATATACTA | 73 | 1348 |
| 1132237 | N/A | N/A | 2551 | 2570 | TCCTGCTGAAGAGCTGTGTA | 66 | 1349 |
| 1132265 | N/A | N/A | 2673 | 2692 | GCTGCTGCTGCTTGTTTCAG | 42 | 1350 |
| 1132293 | N/A | N/A | 2786 | 2805 | TTTTATTTGTAACTCCCAAG | 100 | 1351 |
| 1132321 | N/A | N/A | 2899 | 2918 | TAACCACTCTGATCTGAGCC | 80 | 1352 |
| 1132349 | N/A | N/A | 2989 | 3008 | CCTTGGGTAAGTCTTCAGTC | 107 | 1353 |
| 1132377 | N/A | N/A | 3397 | 3416 | GTCGCTGTGCATTGAAAACA | 98 | 1354 |
| 1132405 | N/A | N/A | 3484 | 3503 | CACACTCTCTGAGGACTTCC | 83 | 1355 |
| 1132433 | N/A | N/A | 3682 | 3701 | CTCTCCAAGCAGAGTTCCTT | 89 | 1356 |
| 1132461 | N/A | N/A | 3848 | 3867 | CCACCCCAGAGGCTGTGTGT | 90 | 1357 |
| 1132489 | N/A | N/A | 3972 | 3991 | GAACTCTCCCTCTGGACTTC | 61 | 1358 |
| 1132517 | N/A | N/A | 4060 | 4079 | CTTCTTGAACCTACTTGCCT | 66 | 1359 |
| 1132545 | N/A | N/A | 4260 | 4279 | GCCCAGGTCCTCCACATCTC | 60 | 1360 |
| 1132573 | N/A | N/A | 4361 | 4380 | GAGGGATAGTGGTCTCAGGA | 76 | 1361 |
| 1132601 | N/A | N/A | 4593 | 4612 | AGAGCTCTCCTTCCTGGCAC | 60 | 1362 |
| 1132629 | N/A | N/A | 4809 | 4828 | TTCCTGGCAAGCCCGTCCCA | 50 | 1363 |
| 1132657 | N/A | N/A | 5079 | 5098 | CCCAGCCCCACGCGGCGCAC | 105 | 1364 |
| 1132685 | N/A | N/A | 5445 | 5464 | GACGGAGAGCCCGCGGCCGG | 109 | 1365 |
| 1132713 | N/A | N/A | 5868 | 5887 | CGAACCCCAATCCCGTGTTC | 81 | 1366 |
| 1132741 | N/A | N/A | 6330 | 6349 | CCCCTGCCCCTAGCAGTTGT | 111 | 1367 |
| 1132769 | N/A | N/A | 6436 | 6455 | CTCACAACCCATCAGGTCAG | 97 | 1368 |
| 1132797 | N/A | N/A | 6542 | 6561 | AGGGAACCAAGAGCAAGTTC | 26 | 1369 |
| 1132825 | N/A | N/A | 6667 | 6686 | GAATGGGCGGAGCGGAAACA | 73 | 1370 |
| 1132853 | N/A | N/A | 6773 | 6792 | ACCCACTCATGCCCTTCCTC | 42 | 1371 |
| 1132881 | N/A | N/A | 7031 | 7050 | CGCCAACCGGGCTAAGAGCT | 82† | 1372 |

TABLE 22

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130753 | 16 | 35 | 16 | 35 | GGTCCAGCTGCCTATCCAGG | 37 | 1373 |
| 1130781 | 60 | 79 | 60 | 79 | CAGGAACCCCAGGAGCAGCA | 65 | 1374 |
| 1130809 | 104 | 123 | N/A | N/A | GCTTCCCAAGGTGGAATCGA | 67 | 1375 |
| 1130837 | 156 | 175 | N/A | N/A | GACAGTGAGAACGACTGTGT | 43 | 1376 |
| 1130865 | 210 | 229 | 3561 | 3580 | TTTGTGGTACAGCTGCCGGT | 52 | 1377 |
| 1130871 | 216 | 235 | 3567 | 3586 | GGTACATTTGTGGTACAGCT | 20 | 183 |
| 1130894 | 257 | 276 | N/A | N/A | GTGGTAGCACACCAGGGCTG | 19 | 1378 |
| 1130922 | 314 | 333 | 3821 | 3840 | TTCACTTTCTTGGGCTCCAA | 36 | 1379 |
| 1130950 | 372 | 391 | 4180 | 4199 | TGGCATGTTCACACAGGTCC | 42 | 1380 |
| 1130978 | 429 | 448 | N/A | N/A | CTCTTTCTGGCAGTGGTTTC | 45 | 1381 |
| 1131006 | 472 | 491 | 4417 | 4436 | CATTCTTGTGGAAAAACCGG | 22 | 1382 |
| 1131034 | 512 | 531 | 4457 | 4476 | CATCTGGCCACAGCTGCTTG | 42 | 1383 |
| 1131062 | 552 | 571 | 4497 | 4516 | GGCCAGCCGCTGGCAGTGGG | 87 | 1384 |
| 1131090 | 589 | 608 | 4673 | 4692 | CCCCATGGAGGCACGGGTTG | 36 | 1385 |
| 1131118 | 628 | 647 | 4712 | 4731 | AGTGGCACAGGCGGTGGCCC | 32 | 1386 |
| 1131146 | 691 | 710 | 4920 | 4939 | GGCCATCATAGCAGCTTGCC | 27 | 1387 |
| 1131174 | 747 | 766 | 4976 | 4995 | CTGACAGGGCGCACCCGAGA | 49 | 1388 |
| 1131202 | 800 | 819 | 5029 | 5048 | TTCCGCGCTTGCTCGGCAGT | 35 | 1389 |
| 1131230 | 883 | 902 | 5197 | 5216 | GCCGGTCGCGGTTCAGCACG | 42 | 1390 |
| 1131258 | 921 | 940 | 5235 | 5254 | GGTCTGGCACTGTGCCAGGT | 34 | 1391 |
| 1131286 | 1012 | 1031 | 5326 | 5345 | TGGGCTGAGGCTTCGGCGGT | 45 | 1392 |
| 1131314 | 1093 | 1112 | 5512 | 5531 | CGTTCCTGGTCAGGGAAGGC | 15 | 1393 |
| 1131342 | 1135 | 1154 | 5554 | 5573 | AAGACAGACTCTTGCGGAGC | 29 | 1394 |
| 1131370 | 1209 | 1228 | 5628 | 5647 | GCCCCAGTACAGCGCGGCGA | 53 | 1395 |
| 1131398 | 1282 | 1301 | 5701 | 5720 | GCCGGTCCTGCAGGCAGTGA | 48 | 1396 |
| 1131426 | 1346 | 1365 | 6006 | 6025 | CACGGCTCACAGCTGTGGTT | 28 | 1397 |
| 1131454 | 1439 | 1458 | 6182 | 6201 | TCCTCCTGAAGGCGCAACAG | 33 | 1398 |
| 1131482 | 1497 | 1516 | 6240 | 6259 | GCTTGGCAGGCACACCGGCT | 41 | 1399 |
| 1131510 | 1565 | 1584 | N/A | N/A | GCCCCCTCGAACTGGTGGCC | 49 | 1400 |
| 1131538 | 1604 | 1623 | 6902 | 6921 | GGTACCTGCGCCTCCTGCAG | 154 | 1401 |
| 1131566 | 1699 | 1718 | 6997 | 7016 | CGGTGCCGCCCTCGAGGAAC | 6† | 1402 |
| 1131594 | 1781 | 1800 | 7169 | 7188 | ATGATGCCTTGCAGGGTGAG | 29 | 1403 |
| 1131622 | 1810 | 1829 | 7198 | 7217 | TGCGGTCACCACAGCCCGAT | 37 | 1404 |
| 1131650 | 1857 | 1876 | 7245 | 7264 | GATCCAGGCCAGGTAGTAGG | 29 | 1405 |
| 1131678 | 1896 | 1915 | 7284 | 7303 | AGATGAGTCCCTGAGCAATC | 32 | 1406 |

TABLE 22-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131706 | 1938 | 1957 | 7326 | 7345 | TGCCCCAGCCACTCTCTCAC | 25 | 1407 |
| 1131734 | 1990 | 2009 | 7378 | 7397 | CCTGGCGCGGAGCTGGCCGC | 44 | 1408 |
| 1131762 | 2024 | 2043 | 7412 | 7431 | ATTTTCAAAGCACTTTATTG | 32 | 1409 |
| 1131790 | N/A | N/A | 142 | 161 | TGATAGCGACCCCCCAGAAC | 80 | 1410 |
| 1131818 | N/A | N/A | 229 | 248 | GCCTTCCGGGCTGGCCTCAC | 91 | 1411 |
| 1131846 | N/A | N/A | 329 | 348 | TTCTACCTCCCCCGTTGTC | 106 | 1412 |
| 1131874 | N/A | N/A | 419 | 438 | AAGTCATAGCCTGCCACCGA | 105 | 1413 |
| 1131902 | N/A | N/A | 563 | 582 | CATACACATCCCCACCCAAG | 85 | 1414 |
| 1131930 | N/A | N/A | 654 | 673 | ACAGCTCACGATCACTCTAG | 67 | 1415 |
| 1131958 | N/A | N/A | 773 | 792 | TGAGGAAGGCTGGCAGGAGC | 76 | 1416 |
| 1131986 | N/A | N/A | 913 | 932 | TGGGCTTCAGAGGCATTCAG | 50 | 1417 |
| 1132014 | N/A | N/A | 1024 | 1043 | AACAACCCTAAGAGGTTTAC | 62 | 1418 |
| 1132042 | N/A | N/A | 1123 | 1142 | CTTCATCTAAAAGGTAGTTT | 48 | 1419 |
| 1132070 | N/A | N/A | 1539 | 1558 | TGGTTCACAGGCCCTGCTAT | 66 | 1420 |
| 1132098 | N/A | N/A | 1670 | 1689 | AGAGGAGAAACTTTTGGGTG | 68 | 1421 |
| 1132126 | N/A | N/A | 2084 | 2103 | CTGAGATGGACCTTTAAGAT | 54 | 1422 |
| 1132154 | N/A | N/A | 2188 | 2207 | TGGCACAAAGTACCTGCTCA | 53 | 1423 |
| 1132182 | N/A | N/A | 2302 | 2321 | CACTGTGATTTTATAGAACA | 65 | 1424 |
| 1132210 | N/A | N/A | 2440 | 2459 | ATGAATCAGCAACACATATA | 58 | 1425 |
| 1132238 | N/A | N/A | 2554 | 2573 | GCCTCCTGCTGAAGAGCTGT | 61 | 1426 |
| 1132266 | N/A | N/A | 2676 | 2695 | CACGCTGCTGCTGCTTGTTT | 75 | 1427 |
| 1132294 | N/A | N/A | 2789 | 2808 | GAATTTTATTTGTAACTCCC | 84 | 1428 |
| 1132322 | N/A | N/A | 2902 | 2921 | TGTTAACCACTCTGATCTGA | 59 | 1429 |
| 1132350 | N/A | N/A | 2992 | 3011 | TGACCTTGGGTAAGTCTTCA | 93 | 1430 |
| 1132378 | N/A | N/A | 3400 | 3419 | AAGGTCGCTGTGCATTGAAA | 84 | 1431 |
| 1132406 | N/A | N/A | 3487 | 3506 | CAACACACTCTCTGAGGACT | 55 | 1432 |
| 1132434 | N/A | N/A | 3685 | 3704 | CCTCTCTCCAAGCAGAGTTC | 49 | 1433 |
| 1132462 | N/A | N/A | 3851 | 3870 | AGGCCACCCCAGAGGCTGTG | 38 | 1434 |
| 1132490 | N/A | N/A | 3975 | 3994 | CCAGAACTCTCCCTCTGGAC | 74 | 1435 |
| 1132518 | N/A | N/A | 4063 | 4082 | GCCCTTCTTGAACCTACTTG | 73 | 1436 |
| 1132546 | N/A | N/A | 4263 | 4282 | CCCGCCCAGGTCCTCCACAT | 59 | 1437 |
| 1132574 | N/A | N/A | 4364 | 4383 | AAAGAGGGATAGTGGTCTCA | 74 | 1438 |
| 1132602 | N/A | N/A | 4596 | 4615 | CAGAGAGCTCTCCTTCCTGG | 81 | 1439 |
| 1132630 | N/A | N/A | 4812 | 4831 | TCCTTCCTGGCAAGCCCGTC | 40 | 1440 |
| 1132658 | N/A | N/A | 5082 | 5101 | TCACCCAGCCCCACGCGGCG | 44 | 1441 |

TABLE 22-continued

Reduction of FXII RNA by 5-10-5 MOE gapmers with mixed
PO/PS internucleoside linkages (Huh7, electroporation,
5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132686 | N/A | N/A | 5448 | 5467 | GAGGACGGAGAGCCCGCGGC | 75 | 1442 |
| 1132714 | N/A | N/A | 5871 | 5890 | TCCCGAACCCCAATCCCGTG | 83 | 1443 |
| 1132742 | N/A | N/A | 6333 | 6352 | CTACCCCTGCCCCTAGCAGT | 70 | 1444 |
| 1132770 | N/A | N/A | 6439 | 6458 | ATTCTCACAACCCATCAGGT | 103 | 1445 |
| 1132798 | N/A | N/A | 6548 | 6567 | GCCCAGAGGGAACCAAGAGC | 85 | 1446 |
| 1132826 | N/A | N/A | 6670 | 6689 | TTTGAATGGGCGGAGCGGAA | 86 | 1447 |
| 1132854 | N/A | N/A | 6776 | 6795 | TAAACCCACTCATGCCCTTC | 87 | 1448 |
| 1132882 | N/A | N/A | 7057 | 7076 | TTGTGCCTGACGGCCTCGGG | 84† | 1449 |

TABLE 23

Reduction of FXII RNA by 5-10-5 MOE gapmers with mixed
PO/PS internucleoside linkages (Huh7, electroporation,
5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130751 | 14 | 33 | 14 | 33 | TCCAGCTGCCTATCCAGGAG | 65 | 1450 |
| 1130779 | 51 | 70 | 51 | 70 | CAGGAGCAGCAGAGCCCTCA | 39 | 1451 |
| 1130807 | 99 | 118 | N/A | N/A | CCAAGGTGGAATCGAAAGTG | 37 | 1452 |
| 1130835 | 153 | 172 | N/A | N/A | AGTGAGAACGACTGTGTGCT | 29 | 1453 |
| 1130863 | 207 | 226 | 3558 | 3577 | GTGGTACAGCTGCCGGTGGT | 23 | 1454 |
| 1130871 | 216 | 235 | 3567 | 3586 | GGTACATTTGTGGTACAGCT | 8 | 183 |
| 1130892 | 242 | 261 | 3593 | 3612 | GGCTGAGGGCCTGGCCGGCC | 54 | 1455 |
| 1130920 | 312 | 331 | 3819 | 3838 | CACTTTCTTGGGCTCCAAAC | 17 | 1456 |
| 1130948 | 370 | 389 | 4178 | 4197 | GCATGTTCACACAGGTCCCT | 36 | 1457 |
| 1130976 | 427 | 446 | 4235 | 4254 | CTTTCTGGCAGTGGTTTCCA | 25 | 1458 |
| 1131004 | 470 | 489 | 4415 | 4434 | TTCTTGTGGAAAAACCGGAG | 28 | 1459 |
| 1131032 | 510 | 529 | 4455 | 4474 | TCTGGCCACAGCTGCTTGCT | 26 | 1460 |
| 1131060 | 550 | 569 | 4495 | 4514 | CCAGCCGCTGGCAGTGGGCA | 53 | 1461 |
| 1131088 | 586 | 605 | 4670 | 4689 | CATGGAGGCACGGGTTGGTG | 89 | 1462 |
| 1131116 | 625 | 644 | 4709 | 4728 | GGCACAGGCGGTGGCCCTCC | 47 | 1463 |
| 1131144 | 688 | 707 | 4917 | 4936 | CATCATAGCAGCTTGCCTTG | 40 | 1464 |
| 1131172 | 744 | 763 | 4973 | 4992 | ACAGGGCGCACCCGAGAGCG | 50 | 1465 |
| 1131200 | 798 | 817 | 5027 | 5046 | CCGCGCTTGCTCGGCAGTCA | 31 | 1466 |
| 1131228 | 876 | 895 | 5190 | 5209 | GCGGTTCAGCACGAAGCACC | 47 | 1467 |
| 1131256 | 919 | 938 | 5233 | 5252 | TCTGGCACTGTGCCAGGTCG | 43 | 1468 |

TABLE 23-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131284 | 1010 | 1029 | 5324 | 5343 | GGCTGAGGCTTCGGCGGTGC | 27 | 1469 |
| 1131312 | 1091 | 1110 | 5510 | 5529 | TTCCTGGTCAGGGAAGGCGG | 35 | 1470 |
| 1131340 | 1133 | 1152 | 5552 | 5571 | GACAGACTCTTGCGGAGCCG | 19 | 1471 |
| 1131368 | 1206 | 1225 | 5625 | 5644 | CCAGTACAGCGCGGCGATGT | 17 | 1472 |
| 1131396 | 1280 | 1299 | 5699 | 5718 | CGGTCCTGCAGGCAGTGAGC | 26 | 1473 |
| 1131424 | 1344 | 1363 | 6004 | 6023 | CGGCTCACAGCTGTGGTTAC | 19 | 1474 |
| 1131452 | 1436 | 1455 | 6179 | 6198 | TCCTGAAGGCGCAACAGAGC | 39 | 1475 |
| 1131480 | 1494 | 1513 | 6237 | 6256 | TGGCAGGCACACCGGCTGAA | 22 | 1476 |
| 1131508 | 1563 | 1582 | N/A | N/A | CCCCTCGAACTGGTGGCCCC | 132 | 1477 |
| 1131536 | 1601 | 1620 | 6899 | 6918 | ACCTGCGCCTCCTGCAGGAA | 108 | 1478 |
| 1131564 | 1694 | 1713 | 6992 | 7011 | CCGCCCTCGAGGAACCCTGC | 10† | 1479 |
| 1131592 | 1778 | 1797 | 7166 | 7185 | ATGCCTTGCAGGGTGAGCCG | 24 | 1480 |
| 1131620 | 1807 | 1826 | 7195 | 7214 | GGTCACCACAGCCCGATCCC | 23 | 1481 |
| 1131648 | 1855 | 1874 | 7243 | 7262 | TCCAGGCCAGGTAGTAGGCC | 81 | 1482 |
| 1131676 | 1894 | 1913 | 7282 | 7301 | ATGAGTCCCTGAGCAATCAG | 44 | 1483 |
| 1131704 | 1933 | 1952 | 7321 | 7340 | CAGCCACTCTCTCACTGCGG | 11 | 1484 |
| 1131732 | 1986 | 2005 | 7374 | 7393 | GCGCGGAGCTGGCCGCACTG | 24 | 1485 |
| 1131760 | 2021 | 2040 | 7409 | 7428 | TTCAAAGCACTTTATTGAGT | 6 | 1486 |
| 1131788 | N/A | N/A | 136 | 155 | CGACCCCCAGAACAATCCT | 54 | 1487 |
| 1131816 | N/A | N/A | 220 | 239 | GCTGGCCTCACCTTTCCACA | 69 | 1488 |
| 1131844 | N/A | N/A | 323 | 342 | CTCCCCCCGTTGTCTTCTTA | 87 | 1489 |
| 1131872 | N/A | N/A | 413 | 432 | TAGCCTGCCACCGATCTGTT | 59 | 1490 |
| 1131900 | N/A | N/A | 557 | 576 | CATCCCCACCCAAGGGTTCC | 80 | 1491 |
| 1131928 | N/A | N/A | 648 | 667 | CACGATCACTCTAGTGCCCA | 67 | 1492 |
| 1131956 | N/A | N/A | 767 | 786 | AGGCTGGCAGGAGCCCAGGT | 61 | 1493 |
| 1131984 | N/A | N/A | 904 | 923 | GAGGCATTCAGATGCCAGAG | 101 | 1494 |
| 1132012 | N/A | N/A | 1018 | 1037 | CCTAAGAGGTTTACTGTTAT | 46 | 1495 |
| 1132040 | N/A | N/A | 1117 | 1136 | CTAAAAGGTAGTTTCATAAT | 70 | 1496 |
| 1132068 | N/A | N/A | 1533 | 1552 | ACAGGCCCTGCTATGTGCCA | 67 | 1497 |
| 1132096 | N/A | N/A | 1647 | 1666 | GGTGAAGAGAGGAGGCTGAG | 68 | 1498 |
| 1132124 | N/A | N/A | 2078 | 2097 | TGGACCTTTAAGATGCAAAT | 53 | 1499 |
| 1132152 | N/A | N/A | 2178 | 2197 | TACCTGCTCAATAAGCTTTT | 54 | 1500 |
| 1132180 | N/A | N/A | 2295 | 2314 | ATTTTATAGAACATAACCAT | 125 | 1501 |
| 1132208 | N/A | N/A | 2430 | 2449 | AACACATATACTAAATAAAA | 88 | 1502 |
| 1132236 | N/A | N/A | 2548 | 2567 | TGCTGAAGAGCTGTGTAGTT | 77 | 1503 |

TABLE 23-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132264 | N/A | N/A | 2670 | 2689 | GCTGCTGCTTGTTTCAGCTC | 72 | 1504 |
| 1132292 | N/A | N/A | 2783 | 2802 | TATTTGTAACTCCCAAGTCA | 66 | 1505 |
| 1132320 | N/A | N/A | 2896 | 2915 | CCACTCTGATCTGAGCCTTG | 87 | 1506 |
| 1132348 | N/A | N/A | 2986 | 3005 | TGGGTAAGTCTTCAGTCCCA | 64 | 1507 |
| 1132376 | N/A | N/A | 3394 | 3413 | GCTGTGCATTGAAAACACTT | 32 | 1508 |
| 1132404 | N/A | N/A | 3481 | 3500 | ACTCTCTGAGGACTTCCCCT | 48 | 1509 |
| 1132432 | N/A | N/A | 3679 | 3698 | TCCAAGCAGAGTTCCTTGGA | 102 | 1510 |
| 1132460 | N/A | N/A | 3845 | 3864 | CCCCAGAGGCTGTGTGTAGC | 80 | 1511 |
| 1132488 | N/A | N/A | 3969 | 3988 | CTCTCCCTCTGGACTTCCAA | 52 | 1512 |
| 1132516 | N/A | N/A | 4057 | 4076 | CTTGAACCTACTTGCCTTGT | 53 | 1513 |
| 1132544 | N/A | N/A | 4257 | 4276 | CAGGTCCTCCACATCTCCTC | 57 | 1514 |
| 1132572 | N/A | N/A | 4358 | 4377 | GGATAGTGGTCTCAGGAGAG | 82 | 1515 |
| 1132600 | N/A | N/A | 4590 | 4609 | GCTCTCCTTCCTGGCACACC | 73 | 1516 |
| 1132628 | N/A | N/A | 4806 | 4825 | CTGGCAAGCCCGTCCCACCT | 52 | 1517 |
| 1132656 | N/A | N/A | 5076 | 5095 | AGCCCCACGCGGCGCACCGG | 60 | 1518 |
| 1132684 | N/A | N/A | 5442 | 5461 | GGAGAGCCCGCGGCCGGCTG | 72 | 1519 |
| 1132712 | N/A | N/A | 5865 | 5884 | ACCCCAATCCCGTGTTCCAG | 64 | 1520 |
| 1132740 | N/A | N/A | 6327 | 6346 | CTGCCCCTAGCAGTTGTGCC | 93 | 1521 |
| 1132768 | N/A | N/A | 6433 | 6452 | ACAACCCATCAGGTCAGCGC | 109 | 1522 |
| 1132796 | N/A | N/A | 6539 | 6558 | GAACCAAGAGCAAGTTCGAT | 67 | 1523 |
| 1132824 | N/A | N/A | 6664 | 6683 | TGGGCGGAGCGGAAACAGAA | 46 | 1524 |
| 1132852 | N/A | N/A | 6770 | 6789 | CACTCATGCCCTTCCTCTCT | 39 | 1525 |
| 1132880 | N/A | N/A | 7028 | 7047 | CAACCGGGCTAAGAGCTCAC | 56† | 1526 |

TABLE 24

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130754 | 18 | 37 | 18 | 37 | TTGGTCCAGCTGCCTATCCA | 28 | 1527 |
| 1130782 | 65 | 84 | 65 | 84 | ACCAGCAGGAACCCCAGGAG | 94 | 1528 |
| 1130810 | 106 | 125 | 473 | 492 | GGGCTTCCCAAGGTGGAATC | 19 | 1529 |
| 1130838 | 157 | 176 | N/A | N/A | TGACAGTGAGAACGACTGTG | 33 | 1530 |

TABLE 24-continued

Reduction of FXII RNA by 5-10-5 MOE gapmers with mixed
PO/PS internucleoside linkages (Huh7, electroporation,
5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130866 | 211 | 230 | 3562 | 3581 | ATTTGTGGTACAGCTGCCGG | 23 | 1531 |
| 1130871 | 216 | 235 | 3567 | 3586 | GGTACATTTGTGGTACAGCT | 11 | 183 |
| 1130895 | 258 | 277 | N/A | N/A | GGTGGTAGCACACCAGGGCT | 48 | 1532 |
| 1130923 | 316 | 335 | 3823 | 3842 | CTTTCACTTTCTTGGGCTCC | 19 | 1533 |
| 1130951 | 374 | 393 | 4182 | 4201 | CTTGGCATGTTCACACAGGT | 26 | 1534 |
| 1130979 | 430 | 449 | N/A | N/A | TCTCTTTCTGGCAGTGGTTT | 17 | 1535 |
| 1131007 | 473 | 492 | 4418 | 4437 | TCATTCTTGTGGAAAAACCG | 18 | 1536 |
| 1131035 | 513 | 532 | 4458 | 4477 | GCATCTGGCCACAGCTGCTT | 38 | 1537 |
| 1131063 | 553 | 572 | 4498 | 4517 | TGGCCAGCCGCTGGCAGTGG | 67 | 1538 |
| 1131091 | 590 | 609 | 4674 | 4693 | CCCCCATGGAGGCACGGGTT | 42 | 208 |
| 1131119 | 630 | 649 | 4714 | 4733 | GCAGTGGCACAGGCGGTGGC | 30 | 1539 |
| 1131147 | 693 | 712 | 4922 | 4941 | GCGGCCATCATAGCAGCTTG | 46 | 1540 |
| 1131175 | 748 | 767 | 4977 | 4996 | GCTGACAGGGCGCACCCGAG | 32 | 1541 |
| 1131203 | 801 | 820 | 5030 | 5049 | GTTCCGCGCTTGCTCGGCAG | 30 | 1542 |
| 1131231 | 884 | 903 | 5198 | 5217 | AGCCGGTCGCGGTTCAGCAC | 25 | 1543 |
| 1131259 | 922 | 941 | 5236 | 5255 | GGGTCTGGCACTGTGCCAGG | 22 | 1544 |
| 1131287 | 1013 | 1032 | 5327 | 5346 | GTGGGCTGAGGCTTCGGCGG | 49 | 1545 |
| 1131315 | 1094 | 1113 | 5513 | 5532 | CCGTTCCTGGTCAGGGAAGG | 46 | 1546 |
| 1131343 | 1136 | 1155 | 5555 | 5574 | GAAGACAGACTCTTGCGGAG | 38 | 1547 |
| 1131371 | 1210 | 1229 | 5629 | 5648 | GGCCCCAGTACAGCGCGGCG | 54 | 1548 |
| 1131399 | 1284 | 1303 | N/A | N/A | GGGCCGGTCCTGCAGGCAGT | 64 | 1549 |
| 1131427 | 1347 | 1366 | 6007 | 6026 | GCACGGCTCACAGCTGTGGT | 50 | 1550 |
| 1131455 | 1440 | 1459 | 6183 | 6202 | ATCCTCCTGAAGGCGCAACA | 29 | 1551 |
| 1131483 | 1499 | 1518 | 6242 | 6261 | CCGCTTGGCAGGCACACCGG | 29 | 1552 |
| 1131511 | 1566 | 1585 | N/A | N/A | CGCCCCCTCGAACTGGTGGC | 126 | 1553 |
| 1131539 | 1605 | 1624 | 6903 | 6922 | CGGTACCTGCGCCTCCTGCA | 79 | 1554 |
| 1131567 | 1700 | 1719 | 6998 | 7017 | TCGGTGCCGCCCTCGAGGAA | 5† | 1555 |
| 1131595 | 1782 | 1801 | 7170 | 7189 | GATGATGCCTTGCAGGGTGA | 15 | 1556 |
| 1131623 | 1811 | 1830 | 7199 | 7218 | TTGCGGTCACCACAGCCCGA | 32 | 1557 |
| 1131651 | 1858 | 1877 | 7246 | 7265 | GGATCCAGGCCAGGTAGTAG | 64 | 1558 |
| 1131679 | 1897 | 1916 | 7285 | 7304 | AAGATGAGTCCCTGAGCAAT | 30 | 1559 |
| 1131707 | 1939 | 1958 | 7327 | 7346 | ATGCCCCAGCCACTCTCTCA | 24 | 1560 |
| 1131735 | 1991 | 2010 | 7379 | 7398 | TCCTGGCGCGGAGCTGGCCG | 25 | 1561 |
| 1131763 | 2026 | 2045 | 7414 | 7433 | GCATTTTCAAAGCACTTTAT | 9 | 1562 |
| 1131791 | N/A | N/A | 145 | 164 | CTGTGATAGCGACCCCCCAG | 57 | 1563 |

TABLE 24-continued

Reduction of FXII RNA by 5-10-5 MOE gapmers with mixed
PO/PS internucleoside linkages (Huh7, electroporation,
5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131819 | N/A | N/A | 241 | 260 | TCCTCTGCCTGGGCCTTCCG | 83 | 1564 |
| 1131847 | N/A | N/A | 332 | 351 | CCTTTCTACCTCCCCCGTT | 78 | 1565 |
| 1131875 | N/A | N/A | 422 | 441 | TATAAGTCATAGCCTGCCAC | 61 | 1566 |
| 1131903 | N/A | N/A | 566 | 585 | CACCATACACATCCCCACCC | 74 | 1567 |
| 1131931 | N/A | N/A | 657 | 676 | CACACAGCTCACGATCACTC | 90 | 1568 |
| 1131959 | N/A | N/A | 776 | 795 | AACTGAGGAAGGCTGGCAGG | 59 | 1569 |
| 1131987 | N/A | N/A | 919 | 938 | TAAAGCTGGGCTTCAGAGGC | 73 | 1570 |
| 1132015 | N/A | N/A | 1027 | 1046 | CTCAACAACCCTAAGAGGTT | 122 | 1571 |
| 1132043 | N/A | N/A | 1126 | 1145 | ACCCTTCATCTAAAAGGTAG | 42 | 1572 |
| 1132071 | N/A | N/A | 1542 | 1561 | ATCTGGTTCACAGGCCCTGC | 44 | 1573 |
| 1132099 | N/A | N/A | 1673 | 1692 | GAGAGAGGAGAAACTTTTGG | 51 | 1574 |
| 1132127 | N/A | N/A | 2087 | 2106 | GATCTGAGATGGACCTTTAA | 68 | 1575 |
| 1132155 | N/A | N/A | 2191 | 2210 | GTCTGGCACAAAGTACCTGC | 66 | 1576 |
| 1132183 | N/A | N/A | 2308 | 2327 | AATGTTCACTGTGATTTTAT | 86 | 1577 |
| 1132211 | N/A | N/A | 2443 | 2462 | TTGATGAATCAGCAACACAT | 86 | 1578 |
| 1132239 | N/A | N/A | 2557 | 2576 | TGAGCCTCCTGCTGAAGAGC | 64 | 1579 |
| 1132267 | N/A | N/A | 2679 | 2698 | CGTCACGCTGCTGCTGCTTG | 92 | 1580 |
| 1132295 | N/A | N/A | 2792 | 2811 | GCTGAATTTTATTTGTAACT | 101 | 1581 |
| 1132323 | N/A | N/A | 2905 | 2924 | CACTGTTAACCACTCTGATC | 49 | 1582 |
| 1132351 | N/A | N/A | 3009 | 3028 | ACAACCTGCTAGCTGTGTGA | 65 | 1583 |
| 1132379 | N/A | N/A | 3403 | 3422 | AAAAAGGTCGCTGTGCATTG | 55 | 1584 |
| 1132407 | N/A | N/A | 3490 | 3509 | GGACAACACACTCTCTGAGG | 54 | 1585 |
| 1132435 | N/A | N/A | 3688 | 3707 | TCCCCTCTCTCCAAGCAGAG | 53 | 1586 |
| 1132463 | N/A | N/A | 3855 | 3874 | CCCCAGGCCACCCCAGAGGC | 67 | 1587 |
| 1132491 | N/A | N/A | 3978 | 3997 | TTCCCAGAACTCTCCCTCTG | 59 | 1588 |
| 1132519 | N/A | N/A | 4066 | 4085 | AAGGCCCTTCTTGAACCTAC | 50 | 1589 |
| 1132547 | N/A | N/A | 4266 | 4285 | CACCCCGCCCAGGTCCTCCA | 99 | 1590 |
| 1132575 | N/A | N/A | 4387 | 4406 | GCTCAAAGCACTTCTCTGGG | 25 | 1591 |
| 1132603 | N/A | N/A | 4599 | 4618 | CCCCAGAGAGCTCTCCTTCC | 76 | 1592 |
| 1132631 | N/A | N/A | 4816 | 4835 | CTCCTCCTTCCTGGCAAGCC | 43 | 1593 |
| 1132659 | N/A | N/A | 5085 | 5104 | GGGTCACCCAGCCCCACGCG | 65 | 1594 |
| 1132687 | N/A | N/A | 5451 | 5470 | GCTGAGGACGGAGAGCCCGC | 88 | 1595 |
| 1132715 | N/A | N/A | 5874 | 5893 | TGCTCCCGAACCCCAATCCC | 43 | 1596 |
| 1132743 | N/A | N/A | 6336 | 6355 | CCCCTACCCCTGCCCCTAGC | 65 | 1597 |
| 1132771 | N/A | N/A | 6442 | 6461 | CACATTCTCACAACCCATCA | 72 | 1598 |

TABLE 24-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132799 | N/A | N/A | 6566 | 6585 | TGGCCTTTGCAGCCCGGCGC | 84 | 1599 |
| 1132827 | N/A | N/A | 6673 | 6692 | GGATTTGAATGGGCGGAGCG | 49 | 1600 |
| 1132855 | N/A | N/A | 6779 | 6798 | TTGTAAACCCACTCATGCCC | 52 | 1601 |
| 1132883 | N/A | N/A | 7060 | 7079 | GATTTGTGCCTGACGGCCTC | 42† | 1602 |

TABLE 25

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130783 | 66 | 85 | 66 | 85 | CACCAGCAGGAACCCCAGGA | 57 | 1603 |
| 1130811 | 125 | 144 | 492 | 511 | TTGTACTTATGCTCCTTGGG | 30 | 1604 |
| 1130839 | 158 | 177 | N/A | N/A | GTGACAGTGAGAACGACTGT | 14 | 1605 |
| 1130867 | 212 | 231 | 3563 | 3582 | CATTTGTGGTACAGCTGCCG | 22 | 1606 |
| 1130871 | 216 | 235 | 3567 | 3586 | GGTACATTTGTGGTACAGCT | 17 | 183 |
| 1130896 | 278 | 297 | 3785 | 3804 | TGGTCCTGATCAAAGTTGGG | 44 | 1607 |
| 1130924 | 317 | 336 | N/A | N/A | TCTTTCACTTTCTTGGGCTC | 30 | 1608 |
| 1130952 | 375 | 394 | 4183 | 4202 | GCTTGGCATGTTCACACAGG | 15 | 1609 |
| 1130980 | 431 | 450 | N/A | N/A | TTCTCTTTCTGGCAGTGGTT | 44 | 1610 |
| 1131008 | 474 | 493 | 4419 | 4438 | CTCATTCTTGTGGAAAAACC | 25 | 1611 |
| 1131036 | 514 | 533 | 4459 | 4478 | GGCATCTGGCCACAGCTGCT | 20 | 1612 |
| 1131064 | 554 | 573 | 4499 | 4518 | CTGGCCAGCCGCTGGCAGTG | 102 | 1613 |
| 1131092 | 591 | 610 | 4675 | 4694 | ACCCCCATGGAGGCACGGGT | 45 | 1614 |
| 1131120 | 631 | 650 | 4715 | 4734 | GGCAGTGGCACAGGCGGTGG | 20 | 1615 |
| 1131148 | 696 | 715 | 4925 | 4944 | CCCGCGGCCATCATAGCAGC | 57 | 1616 |
| 1131176 | 749 | 768 | 4978 | 4997 | GGCTGACAGGGCGCACCCGA | 31 | 1617 |
| 1131204 | 802 | 821 | 5031 | 5050 | AGTTCCGCGCTTGCTCGGCA | 13 | 1618 |
| 1131232 | 886 | 905 | 5200 | 5219 | TCAGCCGGTCGCGGTTCAGC | 39 | 1619 |
| 1131260 | 974 | 993 | 5288 | 5307 | AGTGGGACATGAAGCCTAGG | 34 | 1620 |
| 1131288 | 1060 | 1079 | N/A | N/A | TCGCCGGCAAGGCTCCCGGG | 68 | 1621 |
| 1131316 | 1095 | 1114 | 5514 | 5533 | GCCGTTCCTGGTCAGGGAAG | 27 | 1622 |
| 1131344 | 1138 | 1157 | 5557 | 5576 | TCGAAGACAGACTCTTGCGG | 15 | 1623 |
| 1131372 | 1212 | 1231 | 5631 | 5650 | GTGGCCCCAGTACAGCGCGG | 32 | 1624 |

TABLE 25-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131400 | 1285 | 1304 | N/A | N/A | CGGGCCGGTCCTGCAGGCAG | 34 | 1625 |
| 1131428 | 1351 | 1370 | 6011 | 6030 | TCTGGCACGGCTCACAGCTG | 17 | 1626 |
| 1131456 | 1441 | 1460 | 6184 | 6203 | CATCCTCCTGAAGGCGCAAC | 51 | 1627 |
| 1131484 | 1500 | 1519 | 6243 | 6262 | GCCGCTTGGCAGGCACACCG | 17 | 1628 |
| 1131512 | 1567 | 1586 | N/A | N/A | CCGCCCCCTCGAACTGGTGG | 125 | 1629 |
| 1131540 | 1609 | 1628 | 6907 | 6926 | GGAACGGTACCTGCGCCTCC | 62 | 1630 |
| 1131568 | 1701 | 1720 | 6999 | 7018 | ATCGGTGCCGCCCTCGAGGA | 43† | 1631 |
| 1131596 | 1783 | 1802 | 7171 | 7190 | TGATGATGCCTTGCAGGGTG | 21 | 1632 |
| 1131624 | 1812 | 1831 | 7200 | 7219 | GTTGCGGTCACCACAGCCCG | 20 | 1633 |
| 1131652 | 1860 | 1879 | 7248 | 7267 | CCGGATCCAGGCCAGGTAGT | 30 | 1634 |
| 1131680 | 1898 | 1917 | 7286 | 7305 | AAAGATGAGTCCCTGAGCAA | 20 | 1635 |
| 1131708 | 1940 | 1959 | 7328 | 7347 | CATGCCCCAGCCACTCTCTC | 25 | 1636 |
| 1131736 | 1993 | 2012 | 7381 | 7400 | CATCCTGGCGCGGAGCTGGC | 16 | 1637 |
| 1131764 | 2027 | 2046 | 7415 | 7434 | AGCATTTTCAAAGCACTTTA | 9 | 97 |
| 1131792 | N/A | N/A | 148 | 167 | TGGCTGTGATAGCGACCCCC | 50 | 1638 |
| 1131820 | N/A | N/A | 244 | 263 | GTCTCCTCTGCCTGGGCCTT | 61 | 1639 |
| 1131848 | N/A | N/A | 335 | 354 | AACCCTTTCTACCTCCCCCC | 76 | 1640 |
| 1131876 | N/A | N/A | 425 | 444 | GACTATAAGTCATAGCCTGC | 145 | 1641 |
| 1131904 | N/A | N/A | 569 | 588 | CTGCACCATACACATCCCCA | 37 | 1642 |
| 1131932 | N/A | N/A | 660 | 679 | GATCACACAGCTCACGATCA | 54 | 1643 |
| 1131960 | N/A | N/A | 779 | 798 | GGAAACTGAGGAAGGCTGGC | 85 | 1644 |
| 1131988 | N/A | N/A | 922 | 941 | TGATAAAGCTGGGCTTCAGA | 69 | 1645 |
| 1132016 | N/A | N/A | 1031 | 1050 | CCTTCTCAACAACCCTAAGA | 59 | 1646 |
| 1132044 | N/A | N/A | 1129 | 1148 | GGTACCCTTCATCTAAAAGG | 56 | 1647 |
| 1132072 | N/A | N/A | 1545 | 1564 | TCCATCTGGTTCACAGGCCC | 66 | 1648 |
| 1132100 | N/A | N/A | 1676 | 1695 | CAAGAGAGAGGAGAAACTTT | 108 | 1649 |
| 1132128 | N/A | N/A | 2090 | 2109 | ATGGATCTGAGATGGACCTT | 34 | 1650 |
| 1132156 | N/A | N/A | 2194 | 2213 | AGTGTCTGGCACAAAGTACC | 28 | 1651 |
| 1132184 | N/A | N/A | 2311 | 2330 | TTCAATGTTCACTGTGATTT | 52 | 1652 |
| 1132212 | N/A | N/A | 2446 | 2465 | GCATTGATGAATCAGCAACA | 55 | 1653 |
| 1132240 | N/A | N/A | 2560 | 2579 | CTCTGAGCCTCCTGCTGAAG | 33 | 1654 |
| 1132268 | N/A | N/A | 2697 | 2716 | AGTTAAGGTTCAACAAGGCG | 36 | 1655 |
| 1132296 | N/A | N/A | 2802 | 2821 | GTGCCTACTTGCTGAATTTT | 68 | 1656 |
| 1132324 | N/A | N/A | 2908 | 2927 | AGTCACTGTTAACCACTCTG | 41 | 1657 |
| 1132352 | N/A | N/A | 3012 | 3031 | TCCACAACCTGCTAGCTGTG | 29 | 1658 |

TABLE 25-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132380 | N/A | N/A | 3406 | 3425 | CTCAAAAAGGTCGCTGTGCA | 36 | 1659 |
| 1132408 | N/A | N/A | 3493 | 3512 | CAGGGACAACACACTCTCTG | 86 | 1660 |
| 1132436 | N/A | N/A | 3691 | 3710 | CAGTCCCCTCTCTCCAAGCA | 55 | 1661 |
| 1132464 | N/A | N/A | 3859 | 3878 | AGAGCCCCAGGCCACCCCAG | 39 | 1662 |
| 1132492 | N/A | N/A | 3981 | 4000 | TCCTTCCCAGAACTCTCCCT | 53 | 1663 |
| 1132520 | N/A | N/A | 4069 | 4088 | GCCAAGGCCCTTCTTGAACC | 25 | 1664 |
| 1132548 | N/A | N/A | 4269 | 4288 | CAGCACCCCGCCCAGGTCCT | 73 | 1665 |
| 1132576 | N/A | N/A | 4505 | 4524 | CCCTGGCTGGCCAGCCGCTG | 46 | 1666 |
| 1132604 | N/A | N/A | 4602 | 4621 | CCCCCCCAGAGAGCTCTCCT | 120 | 1667 |
| 1132632 | N/A | N/A | 4819 | 4838 | TCCCTCCTCCTTCCTGGCAA | 30 | 1668 |
| 1132660 | N/A | N/A | 5112 | 5131 | CCGGGAGCCCGGAGCCCTGG | 68 | 1669 |
| 1132688 | N/A | N/A | 5471 | 5490 | AAGGCTGTGGAGGAGCAGGG | 69 | 1670 |
| 1132716 | N/A | N/A | 5877 | 5896 | CCCTGCTCCCGAACCCCAAT | 69 | 1671 |
| 1132744 | N/A | N/A | 6343 | 6362 | GTCTCCTCCCCTACCCCTGC | 63 | 1672 |
| 1132772 | N/A | N/A | 6445 | 6464 | CTACACATTCTCACAACCCA | 57 | 1673 |
| 1132800 | N/A | N/A | 6569 | 6588 | AGTTGGCCTTTGCAGCCCGG | 34 | 1674 |
| 1132828 | N/A | N/A | 6676 | 6695 | CCAGGATTTGAATGGGCGGA | 65 | 1675 |
| 1132856 | N/A | N/A | 6782 | 6801 | CGCTTGTAAACCCACTCATG | 51 | 1676 |
| 1132884 | N/A | N/A | 7063 | 7082 | TGAGATTTGTGCCTGACGGC | 126† | 1677 |

TABLE 26

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130757 | 21 | 40 | 21 | 40 | CCGTTGGTCCAGCTGCCTAT | 42 | 1678 |
| 1130785 | 69 | 88 | 69 | 88 | GCTCACCAGCAGGAACCCCA | 25 | 1679 |
| 1130813 | 127 | 146 | 494 | 513 | CTTTGTACTTATGCTCCTTG | 55 | 1680 |
| 1130841 | 161 | 180 | N/A | N/A | CCGGTGACAGTGAGAACGAC | 11 | 1681 |
| 1130869 | 214 | 233 | 3565 | 3584 | TACATTTGTGGTACAGCTGC | 13 | 1682 |
| 1130871 | 216 | 235 | 3567 | 3586 | GGTACATTTGTGGTACAGCT | 10 | 183 |
| 1130898 | 281 | 300 | 3788 | 3807 | CGCTGGTCCTGATCAAAGTT | 14 | 1683 |

TABLE 26-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130926 | 320 | 339 | N/A | N/A | TGGTCTTTCACTTTCTTGGG | 23 | 1684 |
| 1130954 | 377 | 396 | 4185 | 4204 | CCGCTTGGCATGTTCACACA | 15 | 1685 |
| 1130982 | 435 | 454 | N/A | N/A | GCACTTCTCTTTCTGGCAGT | 21 | 1686 |
| 1131010 | 476 | 495 | 4421 | 4440 | ATCTCATTCTTGTGGAAAAA | 29 | 1687 |
| 1131038 | 517 | 536 | 4462 | 4481 | ACTGGCATCTGGCCACAGCT | 36 | 1688 |
| 1131066 | 556 | 575 | 4501 | 4520 | GGCTGGCCAGCCGCTGGCAG | 51 | 1689 |
| 1131094 | 594 | 613 | 4678 | 4697 | GCGACCCCCATGGAGGCACG | 26 | 1690 |
| 1131122 | 635 | 654 | 4719 | 4738 | ACCGGGCAGTGGCACAGGCG | 50 | 1691 |
| 1131150 | 698 | 717 | 4927 | 4946 | AGCCCGCGGCCATCATAGCA | 56 | 1692 |
| 1131178 | 751 | 770 | 4980 | 4999 | ACGGCTGACAGGGCGCACCC | 29 | 52 |
| 1131206 | 805 | 824 | 5034 | 5053 | CCCAGTTCCGCGCTTGCTCG | 28 | 1693 |
| 1131234 | 889 | 908 | 5203 | 5222 | AGCTCAGCCGGTCGCGGTTC | 25 | 1694 |
| 1131262 | 976 | 995 | 5290 | 5309 | TGAGTGGGACATGAAGCCTA | 25 | 1695 |
| 1131290 | 1062 | 1081 | N/A | N/A | CTTCGCCGGCAAGGCTCCCG | 36 | 1696 |
| 1131318 | 1104 | 1123 | 5523 | 5542 | GCTCAGTGGGCCGTTCCTGG | 31 | 1697 |
| 1131346 | 1140 | 1159 | 5559 | 5578 | CATCGAAGACAGACTCTTGC | 15 | 1698 |
| 1131374 | 1215 | 1234 | 5634 | 5653 | ACTGTGGCCCCAGTACAGCG | 22 | 1699 |
| 1131402 | 1288 | 1307 | N/A | N/A | GTGCGGGCCGGTCCTGCAGG | 79 | 1700 |
| 1131430 | 1353 | 1372 | 6013 | 6032 | CGTCTGGCACGGCTCACAGC | 22 | 1701 |
| 1131458 | 1443 | 1462 | 6186 | 6205 | CGCATCCTCCTGAAGGCGCA | 11 | 1702 |
| 1131486 | 1520 | 1539 | 6263 | 6282 | GTCTCGGAGGGTCGCGCGGC | 47 | 1703 |
| 1131514 | 1569 | 1588 | N/A | N/A | CTCCGCCCCCTCGAACTGGT | 61 | 1704 |
| 1131542 | 1612 | 1631 | 6910 | 6929 | AGAGGAACGGTACCTGCGCC | 155 | 1705 |
| 1131570 | 1704 | 1723 | 7002 | 7021 | CGCATCGGTGCCGCCCTCGA | 20† | 1706 |
| 1131598 | 1785 | 1804 | 7173 | 7192 | GCTGATGATGCCTTGCAGGG | 21 | 1707 |
| 1131626 | 1815 | 1834 | 7203 | 7222 | CTTGTTGCGGTCACCACAGC | 53 | 1708 |
| 1131654 | 1862 | 1881 | 7250 | 7269 | TCCCGGATCCAGGCCAGGTA | 60 | 1709 |
| 1131682 | 1905 | 1924 | 7293 | 7312 | AGGAGGGAAAGATGAGTCCC | 17 | 1710 |
| 1131710 | 1942 | 1961 | 7330 | 7349 | TCCATGCCCCAGCCACTCTC | 10 | 1711 |
| 1131738 | 1995 | 2014 | 7383 | 7402 | GCCATCCTGGCGCGGAGCTG | 21 | 157 |
| 1131766 | 2029 | 2048 | 7417 | 7436 | TCAGCATTTTCAAAGCACTT | 9 | 1712 |
| 1131794 | N/A | N/A | 154 | 173 | GGCTCATGGCTGTGATAGCG | 36 | 1713 |
| 1131822 | N/A | N/A | 250 | 269 | TTGTCTGTCTCCTCTGCCTG | 79 | 1714 |
| 1131850 | N/A | N/A | 341 | 360 | GACCCAAACCCTTTCTACCT | 37 | 1715 |
| 1131878 | N/A | N/A | 431 | 450 | GGAACTGACTATAAGTCATA | 68 | 1716 |

TABLE 26-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131906 | N/A | N/A | 576 | 595 | GCACACACTGCACCATACAC | 74 | 1717 |
| 1131934 | N/A | N/A | 666 | 685 | CTCAAGGATCACACAGCTCA | 55 | 1718 |
| 1131962 | N/A | N/A | 835 | 854 | GCATGAATGATGCCCATGAG | 85 | 1719 |
| 1131990 | N/A | N/A | 928 | 947 | CATAAGTGATAAAGCTGGGC | 42 | 1720 |
| 1132018 | N/A | N/A | 1037 | 1056 | GGTTTCCCTTCTCAACAACC | 58 | 1721 |
| 1132046 | N/A | N/A | 1135 | 1154 | ATGGCAGGTACCCTTCATCT | 85 | 1722 |
| 1132074 | N/A | N/A | 1551 | 1570 | GTAAGGTCCATCTGGTTCAC | 61 | 1723 |
| 1132102 | N/A | N/A | 1682 | 1701 | GTAAGGCAAGAGAGAGGAGA | 35 | 1724 |
| 1132130 | N/A | N/A | 2096 | 2115 | ATGGAAATGGATCTGAGATG | 53 | 1725 |
| 1132158 | N/A | N/A | 2204 | 2223 | AATGCTGAGCAGTGTCTGGC | 59 | 1726 |
| 1132186 | N/A | N/A | 2317 | 2336 | TGCTAGTTCAATGTTCACTG | 31 | 1727 |
| 1132214 | N/A | N/A | 2452 | 2471 | AGCTTAGCATTGATGAATCA | 49 | 1728 |
| 1132242 | N/A | N/A | 2567 | 2586 | AAATGGCCTCTGAGCCTCCT | 67 | 1729 |
| 1132270 | N/A | N/A | 2703 | 2722 | ATTCCCAGTTAAGGTTCAAC | 45 | 1730 |
| 1132298 | N/A | N/A | 2808 | 2827 | GAGAATGTGCCTACTTGCTG | 39 | 1731 |
| 1132326 | N/A | N/A | 2914 | 2933 | TGTTGAAGTCACTGTTAACC | 91 | 1732 |
| 1132354 | N/A | N/A | 3018 | 3037 | CCTGACTCCACAACCTGCTA | 36 | 1733 |
| 1132382 | N/A | N/A | 3412 | 3431 | CAGACCCTCAAAAAGGTCGC | 29 | 1734 |
| 1132410 | N/A | N/A | 3502 | 3521 | TGAGAACTGCAGGGACAACA | 76 | 1735 |
| 1132438 | N/A | N/A | 3697 | 3716 | CTATCACAGTCCCCTCTCTC | 64 | 1736 |
| 1132466 | N/A | N/A | 3865 | 3884 | GAGGAGAGAGCCCCAGGCCA | 51 | 1737 |
| 1132494 | N/A | N/A | 3987 | 4006 | GACCACTCCTTCCCAGAACT | 56 | 1738 |
| 1132522 | N/A | N/A | 4093 | 4112 | GGGAGCTGAGTCACACAGCT | 67 | 1739 |
| 1132550 | N/A | N/A | 4283 | 4302 | TTGCCCCTGTCCCCCAGCAC | 71 | 1740 |
| 1132578 | N/A | N/A | 4511 | 4530 | TGCTCACCCTGGCTGGCCAG | 48 | 1741 |
| 1132606 | N/A | N/A | 4608 | 4627 | TAAAGACCCCCCCAGAGAGC | 30 | 1742 |
| 1132634 | N/A | N/A | 4826 | 4845 | CGCACTCTCCCTCCTCCTTC | 51 | 1743 |
| 1132662 | N/A | N/A | 5146 | 5165 | TCCTGTAGCCACACGACGGG | 52 | 1744 |
| 1132690 | N/A | N/A | 5480 | 5499 | TTCGCCGGCAAGGCTGTGGA | 64 | 1745 |
| 1132718 | N/A | N/A | 5883 | 5902 | GAAGCCCCCTGCTCCCGAAC | 26 | 1746 |
| 1132746 | N/A | N/A | 6349 | 6368 | TCAAAGGTCTCCTCCCCTAC | 45 | 1747 |
| 1132774 | N/A | N/A | 6451 | 6470 | ATTCACCTACACATTCTCAC | 82 | 1748 |
| 1132802 | N/A | N/A | 6575 | 6594 | CGTCCTAGTTGGCCTTTGCA | 86 | 1749 |
| 1132830 | N/A | N/A | 6685 | 6704 | AGAGAAAAGCCAGGATTTGA | 93 | 1750 |

TABLE 26-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132858 | N/A | N/A | 6802 | 6821 | ATGGACAAAGCTGCTCCAGG | 30 | 1751 |
| 1132886 | N/A | N/A | 7069 | 7088 | TGGACCTGAGATTTGTGCCT | 77† | 1752 |

TABLE 27

Reduction of FXII RNA by 5-10-5 MOE gapmers with mixed PO/PS internucleoside linkages (Huh7, electroporation 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130784 | 68 | 87 | 68 | 87 | CTCACCAGCAGGAACCCCAG | 106 | 1753 |
| 1130812 | 126 | 145 | 493 | 512 | TTTGTACTTATGCTCCTTGG | 18 | 1754 |
| 1130840 | 160 | 179 | N/A | N/A | CGGTGACAGTGAGAACGACT | 18 | 1755 |
| 1130868 | 213 | 232 | 3564 | 3583 | ACATTTGTGGTACAGCTGCC | 18 | 1756 |
| 1130871 | 216 | 235 | 3567 | 3586 | GGTACATTTGTGGTACAGCT | 16 | 183 |
| 1130897 | 280 | 299 | 3787 | 3806 | GCTGGTCCTGATCAAAGTTG | 22 | 1757 |
| 1130925 | 319 | 338 | N/A | N/A | GGTCTTTCACTTTCTTGGGC | 16 | 1758 |
| 1130953 | 376 | 395 | 4184 | 4203 | CGCTTGGCATGTTCACACAG | 40 | 1759 |
| 1130981 | 434 | 453 | N/A | N/A | CACTTCTCTTTCTGGCAGTG | 15 | 1760 |
| 1131009 | 475 | 494 | 4420 | 4439 | TCTCATTCTTGTGGAAAAAC | 18 | 1761 |
| 1131037 | 516 | 535 | 4461 | 4480 | CTGGCATCTGGCCACAGCTG | 25 | 1762 |
| 1131065 | 555 | 574 | 4500 | 4519 | GCTGGCCAGCCGCTGGCAGT | 131 | 1763 |
| 1131093 | 592 | 611 | 4676 | 4695 | GACCCCATGGAGGCACGGG | 36 | 1764 |
| 1131121 | 633 | 652 | 4717 | 4736 | CGGGCAGTGGCACAGGCGGT | 20 | 1765 |
| 1131149 | 697 | 716 | 4926 | 4945 | GCCCGCGGCCATCATAGCAG | 35 | 1766 |
| 1131177 | 750 | 769 | 4979 | 4998 | CGGCTGACAGGGCGCACCCG | 26 | 1767 |
| 1131205 | 804 | 823 | 5033 | 5052 | CCAGTTCCGCGCTTGCTCGG | 26 | 1768 |
| 1131233 | 888 | 907 | 5202 | 5221 | GCTCAGCCGGTCGCGGTTCA | 21 | 1769 |
| 1131261 | 975 | 994 | 5289 | 5308 | GAGTGGGACATGAAGCCTAG | 24 | 1770 |
| 1131289 | 1061 | 1080 | N/A | N/A | TTCGCCGGCAAGGCTCCCGG | 40 | 1771 |
| 1131317 | 1102 | 1121 | 5521 | 5540 | TCAGTGGGCCGTTCCTGGTC | 31 | 1772 |
| 1131345 | 1139 | 1158 | 5558 | 5577 | ATCGAAGACAGACTCTTGCG | 19 | 1773 |
| 1131373 | 1213 | 1232 | 5632 | 5651 | TGTGGCCCCAGTACAGCGCG | 43 | 1774 |
| 1131401 | 1286 | 1305 | N/A | N/A | GCGGGCCGGTCCTGCAGGCA | 28 | 1775 |
| 1131429 | 1352 | 1371 | 6012 | 6031 | GTCTGGCACGGCTCACAGCT | 16 | 1776 |

TABLE 27-continued

Reduction of FXII RNA by 5-10-5 MOE gapmers with mixed PO/PS internucleoside linkages (Huh7, electroporation 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131457 | 1442 | 1461 | 6185 | 6204 | GCATCCTCCTGAAGGCGCAA | 24 | 1777 |
| 1131485 | 1501 | 1520 | 6244 | 6263 | CGCCGCTTGGCAGGCACACC | 45 | 1778 |
| 1131513 | 1568 | 1587 | N/A | N/A | TCCGCCCCCTCGAACTGGTG | 70 | 1779 |
| 1131541 | 1610 | 1629 | 6908 | 6927 | AGGAACGGTACCTGCGCCTC | 66 | 1780 |
| 1131597 | 1784 | 1803 | 7172 | 7191 | CTGATGATGCCTTGCAGGGT | 24 | 1781 |
| 1131625 | 1813 | 1832 | 7201 | 7220 | TGTTGCGGTCACCACAGCCC | 15 | 1782 |
| 1131653 | 1861 | 1880 | 7249 | 7268 | CCCGGATCCAGGCCAGGTAG | 40 | 1783 |
| 1131681 | 1901 | 1920 | 7289 | 7308 | GGGAAAGATGAGTCCCTGAG | 19 | 92 |
| 1131709 | 1941 | 1960 | 7329 | 7348 | CCATGCCCCAGCCACTCTCT | 18 | 1784 |
| 1131737 | 1994 | 2013 | 7382 | 7401 | CCATCCTGGCGCGGAGCTGG | 17 | 1785 |
| 1131765 | 2028 | 2047 | 7416 | 7435 | CAGCATTTTCAAAGCACTTT | 39 | 1786 |
| 1131793 | N/A | N/A | 151 | 170 | TCATGGCTGTGATAGCGACC | 80 | 1787 |
| 1131821 | N/A | N/A | 247 | 266 | TCTGTCTCCTCTGCCTGGGC | 91 | 1788 |
| 1131849 | N/A | N/A | 338 | 357 | CCAAACCCTTTCTACCTCCC | 103 | 1789 |
| 1131877 | N/A | N/A | 428 | 447 | ACTGACTATAAGTCATAGCC | 77 | 1790 |
| 1131905 | N/A | N/A | 572 | 591 | ACACTGCACCATACACATCC | 59 | 1791 |
| 1131933 | N/A | N/A | 663 | 682 | AAGGATCACACAGCTCACGA | 64 | 1792 |
| 1131961 | N/A | N/A | 832 | 851 | TGAATGATGCCCATGAGACG | 33 | 1793 |
| 1131989 | N/A | N/A | 925 | 944 | AAGTGATAAAGCTGGGCTTC | 61 | 1794 |
| 1132017 | N/A | N/A | 1034 | 1053 | TTCCCTTCTCAACAACCCTA | 49 | 1795 |
| 1132045 | N/A | N/A | 1132 | 1151 | GCAGGTACCCTTCATCTAAA | 44 | 1796 |
| 1132073 | N/A | N/A | 1548 | 1567 | AGGTCCATCTGGTTCACAGG | 41 | 1797 |
| 1132101 | N/A | N/A | 1679 | 1698 | AGGCAAGAGAGAGGAGAAAC | 37 | 1798 |
| 1132129 | N/A | N/A | 2093 | 2112 | GAAATGGATCTGAGATGGAC | 65 | 1799 |
| 1132157 | N/A | N/A | 2201 | 2220 | GCTGAGCAGTGTCTGGCACA | 35 | 1800 |
| 1132185 | N/A | N/A | 2314 | 2333 | TAGTTCAATGTTCACTGTGA | 44 | 1801 |
| 1132213 | N/A | N/A | 2449 | 2468 | TTAGCATTGATGAATCAGCA | 46 | 1802 |
| 1132241 | N/A | N/A | 2564 | 2583 | TGGCCTCTGAGCCTCCTGCT | 60 | 1803 |
| 1132269 | N/A | N/A | 2700 | 2719 | CCCAGTTAAGGTTCAACAAG | 62 | 1804 |
| 1132297 | N/A | N/A | 2805 | 2824 | AATGTGCCTACTTGCTGAAT | 77 | 1805 |
| 1132325 | N/A | N/A | 2911 | 2930 | TGAAGTCACTGTTAACCACT | 45 | 1806 |
| 1132353 | N/A | N/A | 3015 | 3034 | GACTCCACAACCTGCTAGCT | 62 | 1807 |
| 1132381 | N/A | N/A | 3409 | 3428 | ACCCTCAAAAAGGTCGCTGT | 58 | 1808 |
| 1132409 | N/A | N/A | 3499 | 3518 | GAACTGCAGGGACAACACAC | 48 | 1809 |

TABLE 27-continued

Reduction of FXII RNA by 5-10-5 MOE gapmers with mixed PO/PS internucleoside linkages (Huh7, electroporation 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132437 | N/A | N/A | 3694 | 3713 | TCACAGTCCCCTCTCTCCAA | 63 | 1810 |
| 1132465 | N/A | N/A | 3862 | 3881 | GAGAGAGCCCCAGGCCACCC | 41 | 1811 |
| 1132493 | N/A | N/A | 3984 | 4003 | CACTCCTTCCCAGAACTCTC | 52 | 1812 |
| 1132521 | N/A | N/A | 4090 | 4109 | AGCTGAGTCACACAGCTGGG | 69 | 1813 |
| 1132549 | N/A | N/A | 4272 | 4291 | CCCCAGCACCCCGCCCAGGT | 113 | 1814 |
| 1132577 | N/A | N/A | 4508 | 4527 | TCACCCTGGCTGGCCAGCCG | 103 | 1815 |
| 1132605 | N/A | N/A | 4605 | 4624 | AGACCCCCCCAGAGAGCTCT | 72 | 1816 |
| 1132633 | N/A | N/A | 4823 | 4842 | ACTCTCCCTCCTCCTTCCTG | 42 | 1817 |
| 1132661 | N/A | N/A | 5115 | 5134 | GCGCCGGGAGCCCGGAGCCC | 92 | 1818 |
| 1132689 | N/A | N/A | 5474 | 5493 | GGCAAGGCTGTGGAGGAGCA | 82 | 1819 |
| 1132717 | N/A | N/A | 5880 | 5899 | GCCCCCTGCTCCCGAACCCC | 65 | 1820 |
| 1132745 | N/A | N/A | 6346 | 6365 | AAGGTCTCCTCCCCTACCCC | 68 | 1821 |
| 1132773 | N/A | N/A | 6448 | 6467 | CACCTACACATTCTCACAAC | 66 | 1822 |
| 1132801 | N/A | N/A | 6572 | 6591 | CCTAGTTGGCCTTTGCAGCC | 67 | 1823 |
| 1132829 | N/A | N/A | 6679 | 6698 | AAGCCAGGATTTGAATGGGC | 50 | 1824 |
| 1132857 | N/A | N/A | 6799 | 6818 | GACAAAGCTGCTCCAGGCGC | 74 | 1825 |
| 1131569 | 1703 | 1722 | 7001 | 7020 | GCATCGGTGCCGCCCTCGAG | 8† | 1826 |
| 1132885 | N/A | N/A | 7066 | 7085 | ACCTGAGATTTGTGCCTGAC | 72† | 1827 |

TABLE 28

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130758 | 22 | 41 | 22 | 41 | TCCGTTGGTCCAGCTGCCTA | 70 | 1828 |
| 1130786 | 70 | 89 | 70 | 89 | AGCTCACCAGCAGGAACCCC | 55 | 1829 |
| 1130814 | 128 | 147 | 495 | 514 | GCTTTGTACTTATGCTCCTT | 30 | 1830 |
| 1130842 | 162 | 181 | N/A | N/A | CCCGGTGACAGTGAGAACGA | 43 | 1831 |
| 1130870 | 215 | 234 | 3566 | 3585 | GTACATTTGTGGTACAGCTG | 19 | 182 |
| 1130871 | 216 | 235 | 3567 | 3586 | GGTACATTTGTGGTACAGCT | 10 | 183 |
| 1130899 | 282 | 301 | 3789 | 3808 | TCGCTGGTCCTGATCAAAGT | 30 | 1832 |
| 1130927 | 322 | 341 | N/A | N/A | AGTGGTCTTTCACTTTCTTG | 41 | 1833 |
| 1130955 | 378 | 397 | 4186 | 4205 | GCCGCTTGGCATGTTCACAC | 46 | 1834 |
| 1130983 | 436 | 455 | N/A | N/A | AGCACTTCTCTTTCTGGCAG | 14 | 1835 |

TABLE 28-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131011 | 478 | 497 | 4423 | 4442 | ATATCTCATTCTTGTGGAAA | 39 | 1836 |
| 1131039 | 524 | 543 | 4469 | 4488 | CCCTTGCACTGGCATCTGGC | 38 | 1837 |
| 1131067 | 557 | 576 | 4502 | 4521 | TGGCTGGCCAGCCGCTGGCA | 45 | 1838 |
| 1131095 | 595 | 614 | 4679 | 4698 | AGCGACCCCCATGGAGGCAC | 21 | 1839 |
| 1131123 | 637 | 656 | 4721 | 4740 | CCACCGGGCAGTGGCACAGG | 42 | 1840 |
| 1131151 | 699 | 718 | 4928 | 4947 | GAGCCCGCGGCCATCATAGC | 85 | 1841 |
| 1131179 | 752 | 771 | 4981 | 5000 | CACGGCTGACAGGGCGCACC | 94 | 1842 |
| 1131207 | 808 | 827 | 5037 | 5056 | GTCCCCAGTTCCGCGCTTGC | 90 | 53 |
| 1131235 | 891 | 910 | 5205 | 5224 | CCAGCTCAGCCGGTCGCGGT | 72 | 1843 |
| 1131263 | 977 | 996 | 5291 | 5310 | ATGAGTGGGACATGAAGCCT | 51 | 1844 |
| 1131291 | 1063 | 1082 | N/A | N/A | GCTTCGCCGGCAAGGCTCCC | 41 | 1845 |
| 1131319 | 1106 | 1125 | 5525 | 5544 | CAGCTCAGTGGGCCGTTCCT | 66 | 1846 |
| 1131347 | 1141 | 1160 | 5560 | 5579 | TCATCGAAGACAGACTCTTG | 27 | 1847 |
| 1131375 | 1216 | 1235 | 5635 | 5654 | AACTGTGGCCCCAGTACAGC | 17 | 1848 |
| 1131403 | 1289 | 1308 | N/A | N/A | GGTGCGGGCCGGTCCTGCAG | 79 | 1849 |
| 1131431 | 1371 | 1390 | 6031 | 6050 | GTAGGAGCGCACGGCCAACG | 46 | 1850 |
| 1131459 | 1445 | 1464 | 6188 | 6207 | TCCGCATCCTCCTGAAGGCG | 40 | 1851 |
| 1131487 | 1521 | 1540 | 6264 | 6283 | GGTCTCGGAGGGTCGCGCGG | 61 | 1852 |
| 1131515 | 1570 | 1589 | N/A | N/A | CCTCCGCCCCTCGAACTGG | 258 | 1853 |
| 1131543 | 1613 | 1632 | 6911 | 6930 | GAGAGGAACGGTACCTGCGC | 80 | 1854 |
| 1131571 | 1707 | 1726 | 7005 | 7024 | GCACGCATCGGTGCCGCCCT | 22† | 1855 |
| 1131599 | 1786 | 1805 | 7174 | 7193 | AGCTGATGATGCCTTGCAGG | 25 | 1856 |
| 1131627 | 1816 | 1835 | 7204 | 7223 | GCTTGTTGCGGTCACCACAG | 21 | 1857 |
| 1131655 | 1863 | 1882 | 7251 | 7270 | CTCCCGGATCCAGGCCAGGT | 81 | 1858 |
| 1131683 | 1906 | 1925 | 7294 | 7313 | AAGGAGGGAAAGATGAGTCC | 48 | 1859 |
| 1131711 | 1943 | 1962 | 7331 | 7350 | TTCCATGCCCCAGCCACTCT | 20 | 1860 |
| 1131739 | 1996 | 2015 | 7384 | 7403 | CGCCATCCTGGCGCGGAGCT | 15 | 1861 |
| 1131795 | N/A | N/A | 157 | 176 | CATGGCTCATGGCTGTGATA | 82 | 1862 |
| 1131823 | N/A | N/A | 253 | 272 | TGGTTGTCTGTCTCCTCTGC | 70 | 1863 |
| 1131851 | N/A | N/A | 344 | 363 | CAAGACCCAAACCCTTTCTA | 154 | 1864 |
| 1131879 | N/A | N/A | 434 | 453 | CAGGGAACTGACTATAAGTC | 74 | 1865 |
| 1131907 | N/A | N/A | 579 | 598 | ACTGCACACTGCACCATA | 78 | 1866 |
| 1131935 | N/A | N/A | 669 | 688 | GCCCTCAAGGATCACACAGC | 80 | 1867 |
| 1131963 | N/A | N/A | 838 | 857 | GTGGCATGAATGATGCCCAT | 153 | 1868 |
| 1131991 | N/A | N/A | 931 | 950 | GCTCATAAGTGATAAAGCTG | 36 | 1869 |

TABLE 28-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132019 | N/A | N/A | 1043 | 1062 | CACATGGGTTTCCCTTCTCA | 100 | 1870 |
| 1132047 | N/A | N/A | 1138 | 1157 | GAAATGGCAGGTACCCTTCA | 46 | 1871 |
| 1132075 | N/A | N/A | 1554 | 1573 | AGGGTAAGGTCCATCTGGTT | 85 | 1872 |
| 1132103 | N/A | N/A | 1688 | 1707 | GTTTGGGTAAGGCAAGAGAG | 47 | 1873 |
| 1132131 | N/A | N/A | 2099 | 2118 | TAAATGGAAATGGATCTGAG | 37 | 1874 |
| 1132159 | N/A | N/A | 2207 | 2226 | TGAAATGCTGAGCAGTGTCT | 84 | 1875 |
| 1132187 | N/A | N/A | 2320 | 2339 | GTTTGCTAGTTCAATGTTCA | 56 | 1876 |
| 1132215 | N/A | N/A | 2455 | 2474 | ATCAGCTTAGCATTGATGAA | 44 | 1877 |
| 1132243 | N/A | N/A | 2570 | 2589 | TGGAAATGGCCTCTGAGCCT | 52 | 1878 |
| 1132271 | N/A | N/A | 2706 | 2725 | CACATTCCCAGTTAAGGTTC | 30 | 1879 |
| 1132299 | N/A | N/A | 2811 | 2830 | ATTGAGAATGTGCCTACTTG | 87 | 1880 |
| 1132327 | N/A | N/A | 2917 | 2936 | GAATGTTGAAGTCACTGTTA | 74 | 1881 |
| 1132355 | N/A | N/A | 3021 | 3040 | ACTCCTGACTCCACAACCTG | 49 | 1882 |
| 1132383 | N/A | N/A | 3415 | 3434 | GGACAGACCCTCAAAAAGGT | 72 | 1883 |
| 1132411 | N/A | N/A | 3505 | 3524 | CAGTGAGAACTGCAGGGACA | 73 | 1884 |
| 1132439 | N/A | N/A | 3700 | 3719 | GCCCTATCACAGTCCCCTCT | 61 | 1885 |
| 1132467 | N/A | N/A | 3868 | 3887 | CGGGAGGAGAGAGCCCCAGG | 46 | 1886 |
| 1132495 | N/A | N/A | 3990 | 4009 | TGGGACCACTCCTTCCCAGA | 65 | 1887 |
| 1132523 | N/A | N/A | 4096 | 4115 | GCAGGGAGCTGAGTCACACA | 121 | 1888 |
| 1132551 | N/A | N/A | 4286 | 4305 | GGGTTGCCCCTGTCCCCCAG | 59 | 1889 |
| 1132579 | N/A | N/A | 4514 | 4533 | ATCTGCTCACCCTGGCTGGC | 48 | 1890 |
| 1132607 | N/A | N/A | 4611 | 4630 | GCCTAAAGACCCCCCCAGAG | 75 | 1891 |
| 1132635 | N/A | N/A | 4832 | 4851 | GCTTTCCGCACTCTCCCTCC | 54 | 1892 |
| 1132663 | N/A | N/A | 5149 | 5168 | GGTTCCTGTAGCCACACGAC | 86 | 1893 |
| 1132691 | N/A | N/A | 5483 | 5502 | CGCTTCGCCGGCAAGGCTGT | 41 | 1894 |
| 1132719 | N/A | N/A | 5910 | 5929 | CTCAGACCTGGCCACAAGCG | 89 | 1895 |
| 1132747 | N/A | N/A | 6352 | 6371 | TGATCAAAGGTCTCCTCCCC | 118 | 1896 |
| 1132775 | N/A | N/A | 6454 | 6473 | GGGATTCACCTACACATTCT | 119 | 1897 |
| 1132803 | N/A | N/A | 6600 | 6619 | ACACTAGCCCGGAGCGCGGG | 62 | 1898 |
| 1132831 | N/A | N/A | 6688 | 6707 | TCCAGAGAAAGCCAGGATT | 86 | 1899 |
| 1132859 | N/A | N/A | 6805 | 6824 | ACGATGGACAAAGCTGCTCC | 55 | 1900 |
| 1132887 | N/A | N/A | 7072 | 7091 | CTGTGGACCTGAGATTTGTG | 155† | 1901 |

TABLE 29

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130759 | 24 | 43 | 24 | 43 | CGTCCGTTGGTCCAGCTGCC | 35 | 1902 |
| 1130787 | 71 | 90 | 71 | 90 | AAGCTCACCAGCAGGAACCC | 47 | 1903 |
| 1130815 | 129 | 148 | 496 | 515 | AGCTTTGTACTTATGCTCCT | 44 | 1904 |
| 1130843 | 163 | 182 | N/A | N/A | CCCCGGTGACAGTGAGAACG | 27 | 1905 |
| 1130871 | 216 | 235 | 3567 | 3586 | GGTACATTTGTGGTACAGCT | 17 | 183 |
| 1130872 | 217 | 236 | 3568 | 3587 | GGGTACATTTGTGGTACAGC | 23 | 25 |
| 1130900 | 283 | 302 | 3790 | 3809 | ATCGCTGGTCCTGATCAAAG | 22 | 1906 |
| 1130928 | 323 | 342 | N/A | N/A | CAGTGGTCTTTCACTTTCTT | 12 | 1907 |
| 1130956 | 379 | 398 | 4187 | 4206 | GGCCGCTTGGCATGTTCACA | 66 | 1908 |
| 1130984 | 438 | 457 | N/A | N/A | AAAGCACTTCTCTTTCTGGC | 33 | 1909 |
| 1131012 | 479 | 498 | 4424 | 4443 | CATATCTCATTCTTGTGGAA | 38 | 1910 |
| 1131040 | 525 | 544 | 4470 | 4489 | ACCCTTGCACTGGCATCTGG | 22 | 1911 |
| 1131068 | 558 | 577 | 4503 | 4522 | CTGGCTGGCCAGCCGCTGGC | 26 | 1912 |
| 1131096 | 597 | 616 | 4681 | 4700 | GCAGCGACCCCATGGAGGC | 23 | 1913 |
| 1131124 | 638 | 657 | 4722 | 4741 | CCCACCGGGCAGTGGCACAG | 45 | 1914 |
| 1131152 | 701 | 720 | 4930 | 4949 | CTGAGCCCGCGGCCATCATA | 35 | 1915 |
| 1131180 | 753 | 772 | 4982 | 5001 | CCACGGCTGACAGGGCGCAC | 36 | 1916 |
| 1131208 | 812 | 831 | 5041 | 5060 | CCCAGTCCCCAGTTCCGCGC | 22 | 1917 |
| 1131236 | 892 | 911 | 5206 | 5225 | CCCAGCTCAGCCGGTCGCGG | 71 | 1918 |
| 1131264 | 979 | 998 | 5293 | 5312 | GCATGAGTGGGACATGAAGC | 47 | 1919 |
| 1131292 | 1064 | 1083 | N/A | N/A | CGCTTCGCCGGCAAGGCTCC | 55 | 1920 |
| 1131320 | 1107 | 1126 | 5526 | 5545 | GCAGCTCAGTGGGCCGTTCC | 71 | 1921 |
| 1131348 | 1143 | 1162 | 5562 | 5581 | GGTCATCGAAGACAGACTCT | 22 | 1922 |
| 1131376 | 1218 | 1237 | 5637 | 5656 | GAAACTGTGGCCCCAGTACA | 32 | 1923 |
| 1131404 | 1302 | 1321 | 5962 | 5981 | CGTCAGATCCTCGGGTGCGG | 29 | 1924 |
| 1131432 | 1372 | 1391 | 6032 | 6051 | GGTAGGAGCGCACGGCCAAC | 22 | 1925 |
| 1131460 | 1446 | 1465 | 6189 | 6208 | GTCCGCATCCTCCTGAAGGC | 31 | 1926 |
| 1131488 | 1522 | 1541 | 6265 | 6284 | TGGTCTCGGAGGGTCGCGCG | 40 | 1927 |
| 1131516 | 1571 | 1590 | N/A | N/A | TCCTCCGCCCCCTCGAACTG | 425 | 1928 |
| 1131544 | 1614 | 1633 | 6912 | 6931 | GGAGAGGAACGGTACCTGCG | 87 | 1929 |
| 1131572 | 1709 | 1728 | 7007 | 7026 | TGGCACGCATCGGTGCCGCC | 63[†] | 1930 |
| 1131600 | 1787 | 1806 | 7175 | 7194 | CAGCTGATGATGCCTTGCAG | 90 | 1931 |
| 1131628 | 1817 | 1836 | 7205 | 7224 | GGCTTGTTGCGGTCACCACA | 40 | 1932 |
| 1131656 | 1864 | 1883 | 7252 | 7271 | GCTCCCGGATCCAGGCCAGG | 56 | 1933 |
| 1131684 | 1907 | 1926 | 7295 | 7314 | CAAGGAGGGAAAGATGAGTC | 33 | 1934 |
| 1131712 | 1944 | 1963 | 7332 | 7351 | CTTCCATGCCCCAGCCACTC | 20 | 1935 |

TABLE 29-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131740 | 1997 | 2016 | 7385 | 7404 | GCGCCATCCTGGCGCGGAGC | 38 | 1936 |
| 1131796 | N/A | N/A | 160 | 179 | GGCCATGGCTCATGGCTGTG | 79 | 1937 |
| 1131824 | N/A | N/A | 256 | 275 | GTCTGGTTGTCTGTCTCCTC | 63 | 1938 |
| 1131852 | N/A | N/A | 347 | 366 | TCCCAAGACCCAAACCCTTT | 57 | 1939 |
| 1131880 | N/A | N/A | 437 | 456 | AGGCAGGGAACTGACTATAA | 33 | 1940 |
| 1131908 | N/A | N/A | 582 | 601 | GAGACTGCACACACTGCACC | 40 | 1941 |
| 1131936 | N/A | N/A | 672 | 691 | CCTGCCCTCAAGGATCACAC | 45 | 1942 |
| 1131964 | N/A | N/A | 841 | 860 | TGTGTGGCATGAATGATGCC | 85 | 1943 |
| 1131992 | N/A | N/A | 934 | 953 | CCAGCTCATAAGTGATAAAG | 36 | 1944 |
| 1132020 | N/A | N/A | 1046 | 1065 | CCTCACATGGGTTTCCCTTC | 26 | 1945 |
| 1132048 | N/A | N/A | 1159 | 1178 | TGGCAGAGCTTGAGGAAGGG | 31 | 1946 |
| 1132076 | N/A | N/A | 1557 | 1576 | ACCAGGGTAAGGTCCATCTG | 65 | 1947 |
| 1132104 | N/A | N/A | 1691 | 1710 | CAAGTTTGGGTAAGGCAAGA | 40 | 1948 |
| 1132132 | N/A | N/A | 2102 | 2121 | CAGTAAATGGAAATGGATCT | 64 | 1949 |
| 1132160 | N/A | N/A | 2210 | 2229 | CCATGAAATGCTGAGCAGTG | 46 | 1950 |
| 1132188 | N/A | N/A | 2323 | 2342 | ACTGTTTGCTAGTTCAATGT | 25 | 1951 |
| 1132216 | N/A | N/A | 2458 | 2477 | GCCATCAGCTTAGCATTGAT | 38 | 1952 |
| 1132244 | N/A | N/A | 2573 | 2592 | TTTTGGAAATGGCCTCTGAG | 71 | 1953 |
| 1132272 | N/A | N/A | 2709 | 2728 | TTGCACATTCCCAGTTAAGG | 58 | 1954 |
| 1132300 | N/A | N/A | 2814 | 2833 | TACATTGAGAATGTGCCTAC | 116 | 1955 |
| 1132328 | N/A | N/A | 2920 | 2939 | GTTGAATGTTGAAGTCACTG | 47 | 1956 |
| 1132356 | N/A | N/A | 3024 | 3043 | TAGACTCCTGACTCCACAAC | 110 | 1957 |
| 1132384 | N/A | N/A | 3418 | 3437 | AAAGGACAGACCCTCAAAAA | 113 | 1958 |
| 1132412 | N/A | N/A | 3508 | 3527 | TGACAGTGAGAACTGCAGGG | 30 | 1959 |
| 1132440 | N/A | N/A | 3703 | 3722 | CCTGCCCTATCACAGTCCCC | 84 | 1960 |
| 1132468 | N/A | N/A | 3871 | 3890 | AGGCGGGAGGAGAGAGCCCC | 62 | 1961 |
| 1132496 | N/A | N/A | 3993 | 4012 | AAATGGGACCACTCCTTCCC | 41 | 1962 |
| 1132524 | N/A | N/A | 4099 | 4118 | AGAGCAGGGAGCTGAGTCAC | 60 | 1963 |
| 1132552 | N/A | N/A | 4289 | 4308 | CCAGGGTTGCCCCTGTCCCC | 190 | 1964 |
| 1132580 | N/A | N/A | 4517 | 4536 | ACCATCTGCTCACCCTGGCT | 67 | 1965 |
| 1132608 | N/A | N/A | 4614 | 4633 | TGGGCCTAAAGACCCCCCCA | 74 | 1966 |
| 1132636 | N/A | N/A | 4835 | 4854 | TCTGCTTTCCGCACTCTCCC | 36 | 1967 |
| 1132664 | N/A | N/A | 5152 | 5171 | CCGGGTTCCTGTAGCCACAC | 53 | 1968 |
| 1132692 | N/A | N/A | 5702 | 5721 | CGCCGGTCCTGCAGGCAGTG | 54 | 1969 |
| 1132720 | N/A | N/A | 5913 | 5932 | GCTCTCAGACCTGGCCACAA | 94 | 1970 |

TABLE 29-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132748 | N/A | N/A | 6355 | 6374 | CAGTGATCAAAGGTCTCCTC | 73 | 1971 |
| 1132776 | N/A | N/A | 6457 | 6476 | CCTGGGATTCACCTACACAT | 46 | 1972 |
| 1132804 | N/A | N/A | 6603 | 6622 | CCCACACTAGCCCGGAGCGC | 52 | 1973 |
| 1132832 | N/A | N/A | 6691 | 6710 | AGGTCCAGAGAAAAGCCAGG | 60 | 1974 |
| 1132860 | N/A | N/A | 6808 | 6827 | CGGACGATGGACAAAGCTGC | 37 | 1975 |
| 1132888 | N/A | N/A | 7075 | 7094 | GCGCTGTGGACCTGAGATTT | 87† | 1976 |

TABLE 30

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130788 | 72 | 91 | 72 | 91 | CAAGCTCACCAGCAGGAACC | 44 | 1977 |
| 1130816 | 130 | 149 | 497 | 516 | CAGCTTTGTACTTATGCTCC | 46 | 1978 |
| 1130844 | 164 | 183 | 3515 | 3534 | TCCCCGGTGACAGTGAGAAC | 43 | 24 |
| 1130871 | 216 | 235 | 3567 | 3586 | GGTACATTTGTGGTACAGCT | 12 | 183 |
| 1130873 | 218 | 237 | 3569 | 3588 | TGGGTACATTTGTGGTACAG | 22 | 1979 |
| 1130901 | 284 | 303 | 3791 | 3810 | CATCGCTGGTCCTGATCAAA | 26 | 1980 |
| 1130929 | 324 | 343 | N/A | N/A | GCAGTGGTCTTTCACTTTCT | 35 | 1981 |
| 1130957 | 380 | 399 | 4188 | 4207 | GGGCCGCTTGGCATGTTCAC | 32 | 1982 |
| 1130985 | 439 | 458 | N/A | N/A | CAAAGCACTTCTCTTTCTGG | 34 | 1983 |
| 1131013 | 481 | 500 | 4426 | 4445 | ACCATATCTCATTCTTGTGG | 21 | 1984 |
| 1131041 | 526 | 545 | 4471 | 4490 | GACCCTTGCACTGGCATCTG | 27 | 1985 |
| 1131069 | 559 | 578 | 4504 | 4523 | CCTGGCTGGCCAGCCGCTGG | 76 | 1986 |
| 1131097 | 598 | 617 | 4682 | 4701 | GGCAGCGACCCCCATGGAGG | 24 | 1987 |
| 1131125 | 640 | 659 | 4724 | 4743 | AGCCCACCGGGCAGTGGCAC | 57 | 1988 |
| 1131153 | 702 | 721 | 4931 | 4950 | GCTGAGCCCGCGGCCATCAT | 36 | 1989 |
| 1131181 | 754 | 773 | 4983 | 5002 | CCCACGGCTGACAGGGCGCA | 37 | 1990 |
| 1131209 | 813 | 832 | 5042 | 5061 | GCCCAGTCCCCAGTTCCGCG | 41 | 1991 |
| 1131237 | 893 | 912 | 5207 | 5226 | TCCCAGCTCAGCCGGTCGCG | 40 | 1992 |
| 1131265 | 980 | 999 | 5294 | 5313 | GGCATGAGTGGGACATGAAG | 28 | 1993 |
| 1131293 | 1065 | 1084 | N/A | N/A | CCGCTTCGCCGGCAAGGCTC | 35 | 1994 |
| 1131321 | 1108 | 1127 | 5527 | 5546 | CGCAGCTCAGTGGGCCGTTC | 32 | 1995 |
| 1131349 | 1144 | 1163 | 5563 | 5582 | GGGTCATCGAAGACAGACTC | 44 | 1996 |

TABLE 30-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131377 | 1219 | 1238 | 5638 | 5657 | AGAAACTGTGGCCCCAGTAC | 46 | 1997 |
| 1131405 | 1303 | 1322 | 5963 | 5982 | CCGTCAGATCCTCGGGTGCG | 28 | 1998 |
| 1131433 | 1373 | 1392 | 6033 | 6052 | CGGTAGGAGCGCACGGCCAA | 21 | 1999 |
| 1131461 | 1448 | 1467 | 6191 | 6210 | CCGTCCGCATCCTCCTGAAG | 42 | 2000 |
| 1131489 | 1523 | 1542 | 6266 | 6285 | GTGGTCTCGGAGGGTCGCGC | 41 | 2001 |
| 1131517 | 1572 | 1591 | N/A | N/A | TTCCTCCGCCCCCTCGAACT | 194 | 2002 |
| 1131545 | 1615 | 1634 | 6913 | 6932 | GGGAGAGGAACGGTACCTGC | 65 | 2003 |
| 1131573 | 1710 | 1729 | 7008 | 7027 | CTGGCACGCATCGGTGCCGC | 121† | 2004 |
| 1131601 | 1788 | 1807 | 7176 | 7195 | CCAGCTGATGATGCCTTGCA | 22 | 2005 |
| 1131629 | 1818 | 1837 | 7206 | 7225 | TGGCTTGTTGCGGTCACCAC | 26 | 2006 |
| 1131657 | 1865 | 1884 | 7253 | 7272 | TGCTCCCGGATCCAGGCCAG | 44 | 2007 |
| 1131685 | 1908 | 1927 | 7296 | 7315 | CCAAGGAGGGAAAGATGAGT | 22 | 2008 |
| 1131713 | 1945 | 1964 | 7333 | 7352 | CCTTCCATGCCCCAGCCACT | 15 | 2009 |
| 1131741 | 1999 | 2018 | 7387 | 7406 | CTGCGCCATCCTGGCGCGGA | 83 | 2010 |
| 1131797 | N/A | N/A | 163 | 182 | AGAGGCCATGGCTCATGGCT | 91 | 2011 |
| 1131825 | N/A | N/A | 259 | 278 | CCAGTCTGGTTGTCTGTCTC | 60 | 2012 |
| 1131853 | N/A | N/A | 350 | 369 | TCTTCCCAAGACCCAAACCC | 65 | 2013 |
| 1131881 | N/A | N/A | 440 | 459 | AGAAGGCAGGGAACTGACTA | 84 | 2014 |
| 1131909 | N/A | N/A | 585 | 604 | CCTGAGACTGCACACACTGC | 56 | 2015 |
| 1131937 | N/A | N/A | 675 | 694 | TACCCTGCCCTCAAGGATCA | 42 | 2016 |
| 1131965 | N/A | N/A | 844 | 863 | CTCTGTGTGGCATGAATGAT | 71 | 2017 |
| 1131993 | N/A | N/A | 937 | 956 | CACCCAGCTCATAAGTGATA | 63 | 2018 |
| 1132021 | N/A | N/A | 1049 | 1068 | ATACCTCACATGGGTTTCCC | 59 | 2019 |
| 1132049 | N/A | N/A | 1162 | 1181 | CTATGGCAGAGCTTGAGGAA | 62 | 2020 |
| 1132077 | N/A | N/A | 1560 | 1579 | CCCACCAGGGTAAGGTCCAT | 54 | 2021 |
| 1132105 | N/A | N/A | 1694 | 1713 | CACCAAGTTTGGGTAAGGCA | 34 | 2022 |
| 1132133 | N/A | N/A | 2105 | 2124 | GGACAGTAAATGGAAATGGA | 45 | 2023 |
| 1132161 | N/A | N/A | 2219 | 2238 | GAGATAATGCCATGAAATGC | 56 | 2024 |
| 1132189 | N/A | N/A | 2326 | 2345 | AATACTGTTTGCTAGTTCAA | 52 | 2025 |
| 1132217 | N/A | N/A | 2461 | 2480 | AGTGCCATCAGCTTAGCATT | 51 | 2026 |
| 1132245 | N/A | N/A | 2576 | 2595 | GGCTTTTGGAAATGGCCTCT | 46 | 2027 |
| 1132273 | N/A | N/A | 2712 | 2731 | AATTTGCACATTCCCAGTTA | 64 | 2028 |
| 1132301 | N/A | N/A | 2817 | 2836 | TTCTACATTGAGAATGTGCC | 43 | 2029 |
| 1132329 | N/A | N/A | 2923 | 2942 | CTTGTTGAATGTTGAAGTCA | 50 | 2030 |
| 1132357 | N/A | N/A | 3027 | 3046 | GAGTAGACTCCTGACTCCAC | 73 | 2031 |

TABLE 30-continued

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132385 | N/A | N/A | 3421 | 3440 | GGAAAAGGACAGACCCTCAA | 72 | 2032 |
| 1132413 | N/A | N/A | 3511 | 3530 | CGGTGACAGTGAGAACTGCA | 32 | 2033 |
| 1132441 | N/A | N/A | 3706 | 3725 | CACCCTGCCCTATCACAGTC | 74 | 2034 |
| 1132469 | N/A | N/A | 3874 | 3893 | ATGAGGCGGGAGGAGAGAGC | 72 | 2035 |
| 1132497 | N/A | N/A | 3996 | 4015 | GCAAAATGGGACCACTCCTT | 42 | 2036 |
| 1132525 | N/A | N/A | 4102 | 4121 | GGAAGAGCAGGGAGCTGAGT | 102 | 2037 |
| 1132553 | N/A | N/A | 4292 | 4311 | GGCCCAGGGTTGCCCCTGTC | 75 | 2038 |
| 1132581 | N/A | N/A | 4520 | 4539 | CCAACCATCTGCTCACCCTG | 72 | 2039 |
| 1132609 | N/A | N/A | 4617 | 4636 | CCCTGGGCCTAAAGACCCCC | 115 | 2040 |
| 1132637 | N/A | N/A | 4838 | 4857 | TCATCTGCTTTCCGCACTCT | 44 | 2041 |
| 1132665 | N/A | N/A | 5155 | 5174 | TGTCCGGGTTCCTGTAGCCA | 43 | 2042 |
| 1132693 | N/A | N/A | 5705 | 5724 | ACTCGCCGGTCCTGCAGGCA | 29 | 2043 |
| 1132721 | N/A | N/A | 6089 | 6108 | GCCCCACGCACCCAGGTCG | 132 | 2044 |
| 1132749 | N/A | N/A | 6358 | 6377 | ACCCAGTGATCAAAGGTCTC | 56 | 2045 |
| 1132777 | N/A | N/A | 6460 | 6479 | CTACCTGGGATTCACCTACA | 51 | 2046 |
| 1132805 | N/A | N/A | 6606 | 6625 | GCTCCCACACTAGCCCGGAG | 52 | 2047 |
| 1132833 | N/A | N/A | 6694 | 6713 | CTGAGGTCCAGAGAAAAGCC | 25 | 2048 |
| 1132861 | N/A | N/A | 6811 | 6830 | GCCCGGACGATGGACAAAGC | 86 | 2049 |
| 1132889 | N/A | N/A | 7091 | 7110 | GGAAACACGCAGCTCAGCGC | 87† | 2050 |

TABLE 31

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1130761 | 27 | 46 | 27 | 46 | ATCCGTCCGTTGGTCCAGCT | 24 | 2051 |
| 1130789 | 73 | 92 | 73 | 92 | CCAAGCTCACCAGCAGGAAC | 47 | 2052 |
| 1130817 | 131 | 150 | 498 | 517 | TCAGCTTTGTACTTATGCTC | 43 | 2053 |
| 1130845 | 165 | 184 | 3516 | 3535 | CTCCCCGGTGACAGTGAGAA | 68 | 2054 |
| 1130871 | 216 | 235 | 3567 | 3586 | GGTACATTTGTGGTACAGCT | 16 | 183 |
| 1130874 | 220 | 239 | 3571 | 3590 | TGTGGGTACATTTGTGGTAC | 21 | 2055 |
| 1130902 | 286 | 305 | 3793 | 3812 | CCCATCGCTGGTCCTGATCA | 25 | 2056 |
| 1130930 | 326 | 345 | N/A | N/A | CTGCAGTGGTCTTTCACTTT | 56 | 2057 |
| 1130958 | 400 | 419 | 4208 | 4227 | GTTGTGGACAGAGACAGTGG | 37 | 2058 |

TABLE 31-continued

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1130986 | 440 | 459 | N/A | N/A | TCAAAGCACTTCTCTTTCTG | 41 | 2059 |
| 1131014 | 484 | 503 | 4429 | 4448 | TATACCATATCTCATTCTTG | 41 | 2060 |
| 1131042 | 527 | 546 | 4472 | 4491 | GGACCCTTGCACTGGCATCT | 39 | 2061 |
| 1131070 | 560 | 579 | N/A | N/A | GCCTGGCTGGCCAGCCGCTG | 82 | 2062 |
| 1131098 | 600 | 619 | 4684 | 4703 | TAGGCAGCGACCCCCATGGA | 47 | 2063 |
| 1131126 | 643 | 662 | 4727 | 4746 | TGTAGCCCACCGGGCAGTGG | 24 | 2064 |
| 1131154 | 703 | 722 | 4932 | 4951 | AGCTGAGCCCGCGGCCATCA | 29 | 2065 |
| 1131182 | 756 | 775 | 4985 | 5004 | GGCCCACGGCTGACAGGGCG | 61 | 2066 |
| 1131210 | 815 | 834 | 5044 | 5063 | CCGCCCAGTCCCCAGTTCCG | 27 | 2067 |
| 1131238 | 894 | 913 | 5208 | 5227 | CTCCCAGCTCAGCCGGTCGC | 66 | 2068 |
| 1131266 | 989 | 1008 | 5303 | 5322 | GGCTGCGCGGGCATGAGTGG | 66 | 2069 |
| 1131294 | 1066 | 1085 | 5485 | 5504 | CCCGCTTCGCCGGCAAGGCT | 49 | 2070 |
| 1131322 | 1109 | 1128 | 5528 | 5547 | CCGCAGCTCAGTGGGCCGTT | 67 | 2071 |
| 1131350 | 1146 | 1165 | 5565 | 5584 | GCGGGTCATCGAAGACAGAC | 23 | 2072 |
| 1131378 | 1220 | 1239 | 5639 | 5658 | CAGAAACTGTGGCCCCAGTA | 51 | 2073 |
| 1131406 | 1305 | 1324 | 5965 | 5984 | CACCGTCAGATCCTCGGGTG | 31 | 2074 |
| 1131434 | 1375 | 1394 | 6035 | 6054 | AGCGGTAGGAGCGCACGGCC | 24 | 2075 |
| 1131462 | 1449 | 1468 | 6192 | 6211 | GCCGTCCGCATCCTCCTGAA | 17 | 2076 |
| 1131490 | 1524 | 1543 | 6267 | 6286 | CGTGGTCTCGGAGGGTCGCG | 28 | 2077 |
| 1131518 | 1573 | 1592 | N/A | N/A | ATTCCTCCGCCCCCTCGAAC | 238 | 2078 |
| 1131546 | 1616 | 1635 | 6914 | 6933 | AGGGAGAGGAACGGTACCTG | 50 | 2079 |
| 1131574 | 1712 | 1731 | N/A | N/A | CCCTGGCACGCATCGGTGCC | 56[†] | 2080 |
| 1131602 | 1789 | 1808 | 7177 | 7196 | CCCAGCTGATGATGCCTTGC | 45 | 2081 |
| 1131630 | 1819 | 1838 | 7207 | 7226 | CTGGCTTGTTGCGGTCACCA | 16 | 2082 |
| 1131658 | 1866 | 1885 | 7254 | 7273 | GTGCTCCCGGATCCAGGCCA | 32 | 2083 |
| 1131686 | 1909 | 1928 | 7297 | 7316 | ACCAAGGAGGGAAAGATGAG | 19 | 2084 |
| 1131714 | 1946 | 1965 | 7334 | 7353 | GCCTTCCATGCCCCAGCCAC | 30 | 2085 |
| 1131742 | 2000 | 2019 | 7388 | 7407 | CCTGCGCCATCCTGGCGCGG | 113 | 2086 |
| 1131798 | N/A | N/A | 166 | 185 | AGCAGAGGCCATGGCTCATG | 38 | 2087 |
| 1131826 | N/A | N/A | 262 | 281 | CACCCAGTCTGGTTGTCTGT | 71 | 2088 |
| 1131854 | N/A | N/A | 353 | 372 | ATTTCTTCCCAAGACCCAAA | 74 | 2089 |
| 1131882 | N/A | N/A | 443 | 462 | AGAAGAAGGCAGGGAACTGA | 120 | 2090 |
| 1131910 | N/A | N/A | 591 | 610 | GACTGCCCTGAGACTGCACA | 59 | 2091 |
| 1131938 | N/A | N/A | 678 | 697 | CCATACCCTGCCCTCAAGGA | 46 | 2092 |
| 1131966 | N/A | N/A | 847 | 866 | GGCCTCTGTGTGGCATGAAT | 31 | 2093 |
| 1131994 | N/A | N/A | 941 | 960 | GAGTCACCCAGCTCATAAGT | 80 | 2094 |

TABLE 31-continued

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1132022 | N/A | N/A | 1052 | 1071 | TGAATACCTCACATGGGTTT | 34 | 2095 |
| 1132050 | N/A | N/A | 1165 | 1184 | GAGCTATGGCAGAGCTTGAG | 51 | 2096 |
| 1132078 | N/A | N/A | 1563 | 1582 | AGGCCCACCAGGGTAAGGTC | 61 | 2097 |
| 1132106 | N/A | N/A | 1702 | 1721 | GGATAGGGCACCAAGTTTGG | 77 | 2098 |
| 1132134 | N/A | N/A | 2108 | 2127 | CTAGGACAGTAAATGGAAAT | 33 | 2099 |
| 1132162 | N/A | N/A | 2222 | 2241 | CATGAGATAATGCCATGAAA | 50 | 2100 |
| 1132190 | N/A | N/A | 2329 | 2348 | CCTAATACTGTTTGCTAGTT | 36 | 2101 |
| 1132218 | N/A | N/A | 2464 | 2483 | TATAGTGCCATCAGCTTAGC | 43 | 2102 |
| 1132246 | N/A | N/A | 2579 | 2598 | TTTGGCTTTTGGAAATGGCC | 29 | 2103 |
| 1132274 | N/A | N/A | 2715 | 2734 | AAAAATTTGCACATTCCCAG | 85 | 2104 |
| 1132302 | N/A | N/A | 2820 | 2839 | TGGTTCTACATTGAGAATGT | 76 | 2105 |
| 1132330 | N/A | N/A | 2926 | 2945 | ATACTTGTTGAATGTTGAAG | 52 | 2106 |
| 1132358 | N/A | N/A | 3030 | 3049 | CTGGAGTAGACTCCTGACTC | 62 | 2107 |
| 1132386 | N/A | N/A | 3424 | 3443 | TCAGGAAAAGGACAGACCCT | 36 | 2108 |
| 1132414 | N/A | N/A | 3514 | 3533 | CCCCGGTGACAGTGAGAACT | 33 | 2109 |
| 1132442 | N/A | N/A | 3709 | 3728 | GCCCACCCTGCCCTATCACA | 40 | 2110 |
| 1132470 | N/A | N/A | 3877 | 3896 | GTAATGAGGCGGGAGGAGAG | 46 | 2111 |
| 1132498 | N/A | N/A | 3999 | 4018 | CCTGCAAAATGGGACCACTC | 60 | 2112 |
| 1132526 | N/A | N/A | 4105 | 4124 | GAAGGAAGAGCAGGGAGCTG | 58 | 2113 |
| 1132554 | N/A | N/A | 4295 | 4314 | GTAGGCCCAGGGTTGCCCCT | 71 | 2114 |
| 1132582 | N/A | N/A | 4523 | 4542 | TTCCCAACCATCTGCTCACC | 72 | 2115 |
| 1132610 | N/A | N/A | 4620 | 4639 | CACCCCTGGGCCTAAAGACC | 79 | 2116 |
| 1132638 | N/A | N/A | 4841 | 4860 | CTCTCATCTGCTTTCCGCAC | 60 | 2117 |
| 1132666 | N/A | N/A | 5158 | 5177 | CGTTGTCCGGGTTCCTGTAG | 59 | 2118 |
| 1132694 | N/A | N/A | 5708 | 5727 | GGTACTCGCCGGTCCTGCAG | 37 | 2119 |
| 1132722 | N/A | N/A | 6111 | 6130 | TCTCTTCCCGTCCCCGCGGG | 60 | 2120 |
| 1132750 | N/A | N/A | 6361 | 6380 | CTAACCCAGTGATCAAAGGT | 75 | 2121 |
| 1132778 | N/A | N/A | 6463 | 6482 | ATTCTACCTGGGATTCACCT | 34 | 2122 |
| 1132806 | N/A | N/A | 6609 | 6628 | CTGGCTCCCACACTAGCCCG | 44 | 2123 |
| 1132834 | N/A | N/A | 6697 | 6716 | AGGCTGAGGTCCAGAGAAAA | 96 | 2124 |
| 1132862 | N/A | N/A | 6814 | 6833 | GCCGCCCGGACGATGGACAA | 97 | 2125 |
| 1132890 | N/A | N/A | 7094 | 7113 | GTCGGAAACACGCAGCTCAG | 90† | 2126 |

TABLE 32

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1130762 | 28 | 47 | 28 | 47 | CATCCGTCCGTTGGTCCAGC | 46 | 2127 |
| 1130790 | 74 | 93 | 74 | 93 | TCCAAGCTCACCAGCAGGAA | 41 | 2128 |
| 1130818 | 132 | 151 | 499 | 518 | TTCAGCTTTGTACTTATGCT | 63 | 2129 |
| 1130846 | 166 | 185 | 3517 | 3536 | GCTCCCCGGTGACAGTGAGA | 16 | 2130 |
| 1130871 | 216 | 235 | 3567 | 3586 | GGTACATTTGTGGTACAGCT | 15 | 183 |
| 1130875 | 221 | 240 | 3572 | 3591 | TTGTGGGTACATTTGTGGTA | 31 | 2131 |
| 1130903 | 287 | 306 | 3794 | 3813 | CCCCATCGCTGGTCCTGATC | 20 | 2132 |
| 1130931 | 328 | 347 | N/A | N/A | TGCTGCAGTGGTCTTTCACT | 55 | 2133 |
| 1130959 | 401 | 420 | 4209 | 4228 | TGTTGTGGACAGAGACAGTG | 67 | 2134 |
| 1130987 | 443 | 462 | N/A | N/A | GGCTCAAAGCACTTCTCTTT | 15 | 2135 |
| 1131015 | 485 | 504 | 4430 | 4449 | CTATACCATATCTCATTCTT | 20 | 2136 |
| 1131043 | 529 | 548 | 4474 | 4493 | CAGGACCCTTGCACTGGCAT | 38 | 2137 |
| 1131071 | 561 | 580 | N/A | N/A | GGCCTGGCTGGCCAGCCGCT | 114 | 2138 |
| 1131099 | 601 | 620 | 4685 | 4704 | CTAGGCAGCGACCCCATGG | 40 | 2139 |
| 1131127 | 648 | 667 | 4732 | 4751 | TCCGGTGTAGCCCACCGGGC | 104 | 2140 |
| 1131155 | 704 | 723 | 4933 | 4952 | TAGCTGAGCCCGCGGCCATC | 22 | 2141 |
| 1131183 | 759 | 778 | 4988 | 5007 | CGAGGCCCACGGCTGACAGG | 51 | 2142 |
| 1131211 | 816 | 835 | 5045 | 5064 | GCCGCCCAGTCCCCAGTTCC | 41 | 2143 |
| 1131239 | 896 | 915 | 5210 | 5229 | TACTCCCAGCTCAGCCGGTC | 49 | 2144 |
| 1131267 | 990 | 1009 | 5304 | 5323 | CGGCTGCGCGGGCATGAGTG | 71 | 2145 |
| 1131295 | 1067 | 1086 | 5486 | 5505 | TCCCGCTTCGCCGGCAAGGC | 36 | 2146 |
| 1131323 | 1110 | 1129 | 5529 | 5548 | CCCGCAGCTCAGTGGGCCGT | 33 | 2147 |
| 1131351 | 1147 | 1166 | 5566 | 5585 | CGCGGGTCATCGAAGACAGA | 39 | 2148 |
| 1131379 | 1221 | 1240 | 5640 | 5659 | GCAGAAACTGTGGCCCCAGT | 56 | 2149 |
| 1131407 | 1308 | 1327 | 5968 | 5987 | CACCACCGTCAGATCCTCGG | 40 | 2150 |
| 1131435 | 1376 | 1395 | 6036 | 6055 | AAGCGGTAGGAGCGCACGGC | 25 | 2151 |
| 1131463 | 1451 | 1470 | 6194 | 6213 | CTGCCGTCCGCATCCTCCTG | 22 | 2152 |
| 1131491 | 1542 | 1561 | 6285 | 6304 | GCCGGCCACCTGGCAGAGCG | 87 | 2153 |
| 1131519 | 1574 | 1593 | N/A | N/A | TATTCCTCCGCCCCCTCGAA | 316 | 2154 |
| 1131547 | 1617 | 1636 | 6915 | 6934 | CAGGGAGAGGAACGGTACCT | 116 | 2155 |
| 1131575 | 1743 | 1762 | 7131 | 7150 | GTCCTCACACACCAGCGGGC | 14† | 79 |
| 1131603 | 1790 | 1809 | 7178 | 7197 | CCCCAGCTGATGATGCCTTG | 50 | 2156 |
| 1131631 | 1820 | 1839 | 7208 | 7227 | CCTGGCTTGTTGCGGTCACC | 38 | 85 |
| 1131659 | 1867 | 1886 | 7255 | 7274 | TGTGCTCCCGGATCCAGGCC | 42 | 2157 |
| 1131687 | 1911 | 1930 | 7299 | 7318 | TCACCAAGGAGGGAAAGATG | 17 | 2158 |
| 1131715 | 1947 | 1966 | 7335 | 7354 | TGCCTTCCATGCCCCAGCCA | 36 | 156 |

TABLE 32-continued

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1131743 | 2001 | 2020 | 7389 | 7408 | TCCTGCGCCATCCTGGCGCG | 30 | 2159 |
| 1131799 | N/A | N/A | 169 | 188 | ATGAGCAGAGGCCATGGCTC | 99 | 2160 |
| 1131827 | N/A | N/A | 265 | 284 | ATCCACCCAGTCTGGTTGTC | 89 | 2161 |
| 1131855 | N/A | N/A | 356 | 375 | GAGATTTCTTCCCAAGACCC | 107 | 2162 |
| 1131883 | N/A | N/A | 446 | 465 | GAGAGAAGAAGGCAGGGAAC | 126 | 2163 |
| 1131911 | N/A | N/A | 594 | 613 | CTAGACTGCCCTGAGACTGC | 72 | 2164 |
| 1131939 | N/A | N/A | 681 | 700 | AGCCCATACCCTGCCCTCAA | 38 | 2165 |
| 1131967 | N/A | N/A | 850 | 869 | CCTGGCCTCTGTGTGGCATG | 63 | 2166 |
| 1131995 | N/A | N/A | 947 | 966 | CGCCCAGAGTCACCCAGCTC | 34 | 2167 |
| 1132023 | N/A | N/A | 1055 | 1074 | GGCTGAATACCTCACATGGG | 74 | 2168 |
| 1132051 | N/A | N/A | 1188 | 1207 | TCTGGAAGAATGAAAGCAAT | 62 | 2169 |
| 1132079 | N/A | N/A | 1566 | 1585 | GTCAGGCCCACCAGGGTAAG | 47 | 2170 |
| 1132107 | N/A | N/A | 1705 | 1724 | CAAGGATAGGGCACCAAGTT | 56 | 2171 |
| 1132135 | N/A | N/A | 2114 | 2133 | CCAGAACTAGGACAGTAAAT | 52 | 2172 |
| 1132163 | N/A | N/A | 2225 | 2244 | CTTCATGAGATAATGCCATG | 46 | 2173 |
| 1132191 | N/A | N/A | 2332 | 2351 | GAACCTAATACTGTTTGCTA | 27 | 2174 |
| 1132219 | N/A | N/A | 2467 | 2486 | TGCTATAGTGCCATCAGCTT | 60 | 2175 |
| 1132247 | N/A | N/A | 2582 | 2601 | GGATTTGGCTTTTGGAAATG | 42 | 2176 |
| 1132275 | N/A | N/A | 2718 | 2737 | GTGAAAAATTTGCACATTCC | 50 | 2177 |
| 1132303 | N/A | N/A | 2823 | 2842 | CTCTGGTTCTACATTGAGAA | 36 | 2178 |
| 1132331 | N/A | N/A | 2929 | 2948 | ATAATACTTGTTGAATGTTG | 39 | 2179 |
| 1132359 | N/A | N/A | 3033 | 3052 | TAGCTGGAGTAGACTCCTGA | 92 | 2180 |
| 1132387 | N/A | N/A | 3427 | 3446 | TGGTCAGGAAAAGGACAGAC | 21 | 2181 |
| 1132415 | N/A | N/A | 3605 | 3624 | TAGTCTTACCAGGGCTGAGG | 50 | 2182 |
| 1132443 | N/A | N/A | 3734 | 3753 | CTTCCCTGCTCTACCCAGGG | 56 | 2183 |
| 1132471 | N/A | N/A | 3880 | 3899 | AGAGTAATGAGGCGGGAGGA | 44 | 2184 |
| 1132499 | N/A | N/A | 4002 | 4021 | CCACCTGCAAAATGGGACCA | 29 | 2185 |
| 1132527 | N/A | N/A | 4110 | 4129 | TGGTGGAAGGAAGAGCAGGG | 90 | 2186 |
| 1132555 | N/A | N/A | 4298 | 4317 | TCTGTAGGCCCAGGGTTGCC | 73 | 2187 |
| 1132583 | N/A | N/A | 4526 | 4545 | CCGTTCCCAACCATCTGCTC | 42 | 2188 |
| 1132611 | N/A | N/A | 4623 | 4642 | AGCCACCCCTGGGCCTAAAG | 150 | 2189 |
| 1132639 | N/A | N/A | 4844 | 4863 | TCCCTCTCATCTGCTTTCCG | 26 | 2190 |
| 1132667 | N/A | N/A | 5374 | 5393 | CCACTTCCTAACCTCCCGGG | 129 | 2191 |
| 1132695 | N/A | N/A | 5711 | 5730 | GCGGGTACTCGCCGGTCCTG | 58 | 2192 |
| 1132723 | N/A | N/A | 6114 | 6133 | AGCTCTCTTCCCGTCCCCGC | 67 | 2193 |

TABLE 32-continued

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1132751 | N/A | N/A | 6364 | 6383 | CGCCTAACCCAGTGATCAAA | 91 | 2194 |
| 1132779 | N/A | N/A | 6472 | 6491 | GGCCCTGGGATTCTACCTGG | 50 | 2195 |
| 1132807 | N/A | N/A | 6612 | 6631 | AACCTGGCTCCCACACTAGC | 51 | 2196 |
| 1132835 | N/A | N/A | 6703 | 6722 | GCAAGGAGGCTGAGGTCCAG | 39 | 2197 |
| 1132863 | N/A | N/A | 6817 | 6836 | CTTGCCGCCCGGACGATGGA | 50 | 2198 |
| 1132891 | N/A | N/A | 7097 | 7116 | TGGGTCGGAAACACGCAGCT | 115† | 2199 |

TABLE 33

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1130763 | 30 | 49 | 30 | 49 | GGCATCCGTCCGTTGGTCCA | 21 | 2200 |
| 1130791 | 75 | 94 | 75 | 94 | CTCCAAGCTCACCAGCAGGA | 37 | 2201 |
| 1130819 | 133 | 152 | 500 | 519 | CTTCAGCTTTGTACTTATGC | 70 | 2202 |
| 1130847 | 168 | 187 | 3519 | 3538 | GGGCTCCCCGGTGACAGTGA | 33 | 2203 |
| 1130871 | 216 | 235 | 3567 | 3586 | GGTACATTTGTGGTACAGCT | 14 | 183 |
| 1130876 | 222 | 241 | 3573 | 3592 | CTTGTGGGTACATTTGTGGT | 28 | 2204 |
| 1130904 | 288 | 307 | 3795 | 3814 | TCCCCATCGCTGGTCCTGAT | 43 | 2205 |
| 1130932 | 329 | 348 | N/A | N/A | TTGCTGCAGTGGTCTTTCAC | 24 | 2206 |
| 1130960 | 402 | 421 | 4210 | 4229 | GTGTTGTGGACAGAGACAGT | 34 | 2207 |
| 1130988 | 444 | 463 | N/A | N/A | AGGCTCAAAGCACTTCTCTT | 23 | 2208 |
| 1131016 | 487 | 506 | 4432 | 4451 | TTCTATACCATATCTCATTC | 30 | 2209 |
| 1131044 | 530 | 549 | 4475 | 4494 | TCAGGACCCTTGCACTGGCA | 31 | 2210 |
| 1131072 | 563 | 582 | N/A | N/A | CAGGCCTGGCTGGCCAGCCG | 41 | 2211 |
| 1131100 | 603 | 622 | 4687 | 4706 | CTCTAGGCAGCGACCCCCAT | 22 | 2212 |
| 1131128 | 649 | 668 | 4733 | 4752 | CTCCGGTGTAGCCCACCGGG | 44 | 2213 |
| 1131156 | 706 | 725 | 4935 | 4954 | GGTAGCTGAGCCCGCGGCCA | 29 | 2214 |
| 1131184 | 760 | 779 | 4989 | 5008 | CCGAGGCCCACGGCTGACAG | 78 | 2215 |
| 1131212 | 819 | 838 | 5048 | 5067 | GTGGCCGCCCAGTCCCCAGT | 52 | 2216 |
| 1131240 | 897 | 916 | 5211 | 5230 | GTACTCCCAGCTCAGCCGGT | 33 | 2217 |
| 1131268 | 991 | 1010 | 5305 | 5324 | CCGGCTGCGCGGGCATGAGT | 29 | 2218 |
| 1131296 | 1068 | 1087 | 5487 | 5506 | CTCCCGCTTCGCCGGCAAGG | 35 | 2219 |
| 1131324 | 1113 | 1132 | 5532 | 5551 | CTGCCCGCAGCTCAGTGGGC | 53 | 2220 |
| 1131352 | 1149 | 1168 | 5568 | 5587 | GACGCGGGTCATCGAAGACA | 30 | 2221 |

TABLE 33-continued

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1131380 | 1222 | 1241 | 5641 | 5660 | CGCAGAAACTGTGGCCCCAG | 31 | 2222 |
| 1131408 | 1309 | 1328 | 5969 | 5988 | GCACCACCGTCAGATCCTCG | 49 | 2223 |
| 1131436 | 1377 | 1396 | 6037 | 6056 | CAAGCGGTAGGAGCGCACGG | 33 | 2224 |
| 1131464 | 1452 | 1471 | 6195 | 6214 | GCTGCCGTCCGCATCCTCCT | 38 | 2225 |
| 1131492 | 1544 | 1563 | 6287 | 6306 | CAGCCGGCCACCTGGCAGAG | 63 | 2226 |
| 1131520 | 1575 | 1594 | N/A | N/A | ATATTCCTCCGCCCCCTCGA | 216 | 2227 |
| 1131548 | 1618 | 1637 | 6916 | 6935 | CCAGGGAGAGGAACGGTACC | 119 | 2228 |
| 1131604 | 1791 | 1810 | 7179 | 7198 | TCCCCAGCTGATGATGCCTT | 29 | 2229 |
| 1131632 | 1821 | 1840 | 7209 | 7228 | GCCTGGCTTGTTGCGGTCAC | 27 | 2230 |
| 1131660 | 1868 | 1887 | 7256 | 7275 | GTGTGCTCCCGGATCCAGGC | 43 | 2231 |
| 1131688 | 1913 | 1932 | 7301 | 7320 | AATCACCAAGGAGGGAAAGA | 14 | 2232 |
| 1131716 | 1948 | 1967 | 7336 | 7355 | TTGCCTTCCATGCCCCAGCC | 19 | 2233 |
| 1131744 | 2003 | 2022 | 7391 | 7410 | GTTCCTGCGCCATCCTGGCG | 7 | 2234 |
| 1131772 | N/A | N/A | 88 | 107 | CCGAAAGTGTTGACTCCAAG | 64 | 2235 |
| 1131800 | N/A | N/A | 172 | 191 | GTCATGAGCAGAGGCCATGG | 43 | 2236 |
| 1131828 | N/A | N/A | 268 | 287 | TGTATCCACCCAGTCTGGTT | 70 | 2237 |
| 1131856 | N/A | N/A | 359 | 378 | GCAGAGATTTCTTCCCAAGA | 53 | 2238 |
| 1131884 | N/A | N/A | 451 | 470 | CAAGGGAGAGAAGAAGGCAG | 75 | 2239 |
| 1131912 | N/A | N/A | 597 | 616 | AGACTAGACTGCCCTGAGAC | 40 | 2240 |
| 1131940 | N/A | N/A | 684 | 703 | CACAGCCCATACCCTGCCCT | 57 | 2241 |
| 1131968 | N/A | N/A | 853 | 872 | GGCCCTGGCCTCTGTGTGGC | 70 | 2242 |
| 1131996 | N/A | N/A | 951 | 970 | CCCTCGCCCAGAGTCACCCA | 58 | 2243 |
| 1132024 | N/A | N/A | 1058 | 1077 | ATGGGCTGAATACCTCACAT | 44 | 2244 |
| 1132052 | N/A | N/A | 1191 | 1210 | GTGTCTGGAAGAATGAAAGC | 45 | 2245 |
| 1132080 | N/A | N/A | 1569 | 1588 | CAAGTCAGGCCCACCAGGGT | 47 | 2246 |
| 1132108 | N/A | N/A | 1708 | 1727 | AGGCAAGGATAGGGCACCAA | 44 | 2247 |
| 1132136 | N/A | N/A | 2117 | 2136 | AAACCAGAACTAGGACAGTA | 52 | 2248 |
| 1132164 | N/A | N/A | 2228 | 2247 | GGGCTTCATGAGATAATGCC | 63 | 2249 |
| 1132192 | N/A | N/A | 2335 | 2354 | CAGGAACCTAATACTGTTTG | 66 | 2250 |
| 1132220 | N/A | N/A | 2470 | 2489 | GTGTGCTATAGTGCCATCAG | 44 | 2251 |
| 1132248 | N/A | N/A | 2601 | 2620 | CACTTTGTGCTTTTGCTGGG | 59 | 2252 |
| 1132276 | N/A | N/A | 2721 | 2740 | GCAGTGAAAAATTTGCACAT | 41 | 2253 |
| 1132304 | N/A | N/A | 2826 | 2845 | CTTCTCTGGTTCTACATTGA | 52 | 2254 |
| 1132332 | N/A | N/A | 2933 | 2952 | CTTAATAATACTTGTTGAAT | 56 | 2255 |
| 1132360 | N/A | N/A | 3036 | 3055 | AGATAGCTGGAGTAGACTCC | 57 | 2256 |

TABLE 33-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1132388 | N/A | N/A | 3430 | 3449 | GTCTGGTCAGGAAAAGGACA | 74 | 2257 |
| 1132416 | N/A | N/A | 3625 | 3644 | CCTGCTCCAACTCCTCTGCG | 27 | 2258 |
| 1132444 | N/A | N/A | 3737 | 3756 | AGGCTTCCCTGCTCTACCCA | 61 | 2259 |
| 1132472 | N/A | N/A | 3883 | 3902 | AGGAGAGTAATGAGGCGGGA | 46 | 2260 |
| 1132500 | N/A | N/A | 4009 | 4028 | GGTTTACCCACCTGCAAAAT | 36 | 2261 |
| 1132528 | N/A | N/A | 4113 | 4132 | ACATGGTGGAAGGAAGAGCA | 35 | 2262 |
| 1132556 | N/A | N/A | 4301 | 4320 | TATTCTGTAGGCCCAGGGTT | 71 | 2263 |
| 1132584 | N/A | N/A | 4529 | 4548 | GGCCCGTTCCCAACCATCTG | 43 | 2264 |
| 1132612 | N/A | N/A | 4626 | 4645 | GTGAGCCACCCCTGGGCCTA | 80 | 2265 |
| 1132640 | N/A | N/A | 4848 | 4867 | TGCCTCCCTCTCATCTGCTT | 74 | 2266 |
| 1132668 | N/A | N/A | 5377 | 5396 | CCCCCACTTCCTAACCTCCC | 60 | 2267 |
| 1132696 | N/A | N/A | 5745 | 5764 | GAGGAGCCGCGGCCCCTGGG | 70 | 2268 |
| 1132724 | N/A | N/A | 6117 | 6136 | CCAAGCTCTCTTCCCGTCCC | 60 | 2269 |
| 1132752 | N/A | N/A | 6367 | 6386 | TTCCGCCTAACCCAGTGATC | 68 | 2270 |
| 1132780 | N/A | N/A | 6475 | 6494 | CCAGGCCCTGGGATTCTACC | 46 | 2271 |
| 1132808 | N/A | N/A | 6615 | 6634 | CAGAACCTGGCTCCCACACT | 83 | 2272 |
| 1132836 | N/A | N/A | 6706 | 6725 | TAGGCAAGGAGGCTGAGGTC | 80 | 2273 |
| 1132864 | N/A | N/A | 6820 | 6839 | ACGCTTGCCGCCCGGACGAT | 83 | 2274 |
| 1132892 | N/A | N/A | 7100 | 7119 | CCCTGGGTCGGAAACACGCA | 50† | 2275 |

TABLE 34

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1130764 | 31 | 50 | 31 | 50 | TGGCATCCGTCCGTTGGTCC | 45 | 2276 |
| 1130792 | 77 | 96 | 77 | 96 | GACTCCAAGCTCACCAGCAG | 69 | 2277 |
| 1130820 | 134 | 153 | 501 | 520 | TCTTCAGCTTTGTACTTATG | 43 | 2278 |
| 1130848 | 169 | 188 | 3520 | 3539 | AGGGCTCCCCGGTGACAGTG | 30 | 2279 |
| 1130871 | 216 | 235 | 3567 | 3586 | GGTACATTTGTGGTACAGCT | 17 | 183 |
| 1130877 | 224 | 243 | 3575 | 3594 | CCCTTGTGGGTACATTTGTG | 45 | 2280 |
| 1130905 | 289 | 308 | 3796 | 3815 | ATCCCCATCGCTGGTCCTGA | 48 | 2281 |
| 1130933 | 330 | 349 | N/A | N/A | TTTGCTGCAGTGGTCTTTCA | 37 | 2282 |
| 1130961 | 403 | 422 | 4211 | 4230 | GGTGTTGTGGACAGAGACAG | 43 | 2283 |
| 1130989 | 445 | 464 | 4390 | 4409 | GAGGCTCAAAGCACTTCTCT | 32 | 2284 |

TABLE 34-continued

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1131017 | 488 | 507 | 4433 | 4452 | GTTCTATACCATATCTCATT | 37 | 2285 |
| 1131045 | 531 | 550 | 4476 | 4495 | ATCAGGACCCTTGCACTGGC | 38 | 2286 |
| 1131073 | 564 | 583 | N/A | N/A | GCAGGCCTGGCTGGCCAGCC | 50 | 2287 |
| 1131101 | 604 | 623 | 4688 | 4707 | CCTCTAGGCAGCGACCCCCA | 41 | 2288 |
| 1131129 | 651 | 670 | 4735 | 4754 | GGCTCCGGTGTAGCCCACCG | 60 | 2289 |
| 1131157 | 707 | 726 | 4936 | 4955 | CGGTAGCTGAGCCCGCGGCC | 55 | 2290 |
| 1131185 | 761 | 780 | 4990 | 5009 | TCCGAGGCCCACGGCTGACA | 49 | 2291 |
| 1131213 | 836 | 855 | N/A | N/A | GGGTTCCGGCAGAAGGCGTG | 66 | 2292 |
| 1131241 | 899 | 918 | 5213 | 5232 | CAGTACTCCCAGCTCAGCCG | 38 | 2293 |
| 1131269 | 992 | 1011 | 5306 | 5325 | GCCGGCTGCGCGGGCATGAG | 51 | 2294 |
| 1131297 | 1070 | 1089 | 5489 | 5508 | TGCTCCCGCTTCGCCGGCAA | 30 | 2295 |
| 1131325 | 1115 | 1134 | 5534 | 5553 | CGCTGCCCGCAGCTCAGTGG | 45 | 2296 |
| 1131353 | 1150 | 1169 | 5569 | 5588 | CGACGCGGGTCATCGAAGAC | 67 | 2297 |
| 1131381 | 1223 | 1242 | 5642 | 5661 | GCGCAGAAACTGTGGCCCCA | 47 | 112 |
| 1131409 | 1310 | 1329 | 5970 | 5989 | AGCACCACCGTCAGATCCTC | 18 | 2298 |
| 1131437 | 1378 | 1397 | 6038 | 6057 | GCAAGCGGTAGGAGCGCACG | 50 | 2299 |
| 1131465 | 1455 | 1474 | 6198 | 6217 | GCAGCTGCCGTCCGCATCCT | 45 | 70 |
| 1131493 | 1547 | 1566 | 6290 | 6309 | CCCCAGCCGGCCACCTGGCA | 74 | 2300 |
| 1131521 | 1577 | 1596 | N/A | N/A | GCATATTCCTCCGCCCCCTC | 148 | 2301 |
| 1131549 | 1619 | 1638 | 6917 | 6936 | TCCAGGGAGAGGAACGGTAC | 130 | 2302 |
| 1131577 | 1745 | 1764 | 7133 | 7152 | TGGTCCTCACACACCAGCGG | 6† | 2303 |
| 1131605 | 1792 | 1811 | 7180 | 7199 | ATCCCCAGCTGATGATGCCT | 28 | 2304 |
| 1131633 | 1822 | 1841 | 7210 | 7229 | CGCCTGGCTTGTTGCGGTCA | 34 | 2305 |
| 1131661 | 1869 | 1888 | 7257 | 7276 | GGTGTGCTCCCGGATCCAGG | 39 | 2306 |
| 1131689 | 1914 | 1933 | 7302 | 7321 | GAATCACCAAGGAGGGAAAG | 21 | 2307 |
| 1131717 | 1949 | 1968 | 7337 | 7356 | CTTGCCTTCCATGCCCCAGC | 24 | 2308 |
| 1131745 | 2004 | 2023 | 7392 | 7411 | AGTTCCTGCGCCATCCTGGC | 25 | 2309 |
| 1131773 | N/A | N/A | 91 | 110 | TCACCGAAAGTGTTGACTCC | 87 | 2310 |
| 1131801 | N/A | N/A | 175 | 194 | CAGGTCATGAGCAGAGGCCA | 70 | 2311 |
| 1131829 | N/A | N/A | 271 | 290 | CCTTGTATCCACCCAGTCTG | 76 | 2312 |
| 1131857 | N/A | N/A | 365 | 384 | AGAAATGCAGAGATTTCTTC | 91 | 2313 |
| 1131885 | N/A | N/A | 454 | 473 | CTACAAGGGAGAGAAGAAGG | 88 | 2314 |
| 1131913 | N/A | N/A | 600 | 619 | ACTAGACTAGACTGCCCTGA | 77 | 2315 |
| 1131941 | N/A | N/A | 687 | 706 | AGACACAGCCCATACCCTGC | 41 | 2316 |
| 1131969 | N/A | N/A | 856 | 875 | GAAGGCCCTGGCCTCTGTGT | 31 | 2317 |

TABLE 34-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1131997 | N/A | N/A | 954 | 973 | AATCCCTCGCCCAGAGTCAC | 90 | 2318 |
| 1132025 | N/A | N/A | 1061 | 1080 | GTGATGGGCTGAATACCTCA | 49 | 2319 |
| 1132053 | N/A | N/A | 1194 | 1213 | TTAGTGTCTGGAAGAATGAA | 60 | 2320 |
| 1132081 | N/A | N/A | 1572 | 1591 | CACCAAGTCAGGCCCACCAG | 80 | 2321 |
| 1132109 | N/A | N/A | 1711 | 1730 | ATTAGGCAAGGATAGGGCAC | 32 | 2322 |
| 1132137 | N/A | N/A | 2120 | 2139 | ACCAAACCAGAACTAGGACA | 56 | 2323 |
| 1132165 | N/A | N/A | 2250 | 2269 | CTTCTTCAGAGGAATTGTCG | 59 | 2324 |
| 1132193 | N/A | N/A | 2338 | 2357 | TCACAGGAACCTAATACTGT | 61 | 2325 |
| 1132221 | N/A | N/A | 2473 | 2492 | GGTGTGTGCTATAGTGCCAT | 59 | 2326 |
| 1132249 | N/A | N/A | 2604 | 2623 | TCACACTTTGTGCTTTTGCT | 35 | 2327 |
| 1132277 | N/A | N/A | 2724 | 2743 | AGAGCAGTGAAAAATTTGCA | 44 | 2328 |
| 1132305 | N/A | N/A | 2829 | 2848 | ATTCTTCTCTGGTTCTACAT | 56 | 2329 |
| 1132333 | N/A | N/A | 2936 | 2955 | GCACTTAATAATACTTGTTG | 41 | 2330 |
| 1132361 | N/A | N/A | 3039 | 3058 | GTCAGATAGCTGGAGTAGAC | 36 | 2331 |
| 1132389 | N/A | N/A | 3433 | 3452 | AGGGTCTGGTCAGGAAAAGG | 47 | 2332 |
| 1132417 | N/A | N/A | 3628 | 3647 | GCCCCTGCTCCAACTCCTCT | 63 | 2333 |
| 1132445 | N/A | N/A | 3740 | 3759 | ACAAGGCTTCCCTGCTCTAC | 102 | 2334 |
| 1132473 | N/A | N/A | 3886 | 3905 | ACCAGGAGAGTAATGAGGCG | 47 | 2335 |
| 1132501 | N/A | N/A | 4012 | 4031 | CTTGGTTTACCCACCTGCAA | 59 | 2336 |
| 1132529 | N/A | N/A | 4116 | 4135 | TGGACATGGTGGAAGGAAGA | 94 | 2337 |
| 1132557 | N/A | N/A | 4304 | 4323 | ACCTATTCTGTAGGCCCAGG | 53 | 2338 |
| 1132585 | N/A | N/A | 4532 | 4551 | CCTGGCCCGTTCCCAACCAT | 64 | 2339 |
| 1132613 | N/A | N/A | 4629 | 4648 | GCAGTGAGCCACCCCTGGGC | 72 | 2340 |
| 1132641 | N/A | N/A | 4851 | 4870 | TCCTGCCTCCCTCTCATCTG | 66 | 2341 |
| 1132669 | N/A | N/A | 5380 | 5399 | CCCCCCCCACTTCCTAACCT | 84 | 2342 |
| 1132697 | N/A | N/A | 5748 | 5767 | ACGGAGGAGCCGCGGCCCCT | 52 | 2343 |
| 1132725 | N/A | N/A | 6120 | 6139 | GCCCCAAGCTCTCTTCCCGT | 120 | 2344 |
| 1132753 | N/A | N/A | 6370 | 6389 | TTCTTCCGCCTAACCCAGTG | 71 | 2345 |
| 1132781 | N/A | N/A | 6478 | 6497 | ATCCCAGGCCCTGGGATTCT | 79 | 2346 |
| 1132809 | N/A | N/A | 6618 | 6637 | TCGCAGAACCTGGCTCCCAC | 60 | 2347 |
| 1132837 | N/A | N/A | 6709 | 6728 | TCATAGGCAAGGAGGCTGAG | 78 | 2348 |
| 1132865 | N/A | N/A | 6836 | 6855 | CACACCCCATCTGACAACGC | 82 | 2349 |
| 1132893 | N/A | N/A | 7103 | 7122 | TCACCCTGGGTCGGAAACAC | 73† | 2350 |

TABLE 35

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130793 | 78 | 97 | 78 | 97 | TGACTCCAAGCTCACCAGCA | 34 | 239 |
| 1130821 | 135 | 154 | 502 | 521 | CTCTTCAGCTTTGTACTTAT | 42 | 240 |
| 1130849 | 171 | 190 | 3522 | 3541 | GCAGGGCTCCCCGGTGACAG | 34 | 241 |
| 1130871 | 216 | 235 | 3567 | 3586 | GGTACATTTGTGGTACAGCT | 11 | 183 |
| 1130878 | 225 | 244 | 3576 | 3595 | GCCCTTGTGGGTACATTTGT | 33 | 242 |
| 1130906 | 290 | 309 | 3797 | 3816 | TATCCCCATCGCTGGTCCTG | 26 | 243 |
| 1130934 | 331 | 350 | N/A | N/A | GTTTGCTGCAGTGGTCTTTC | 21 | 244 |
| 1130962 | 404 | 423 | 4212 | 4231 | AGGTGTTGTGGACAGAGACA | 45 | 245 |
| 1130990 | 446 | 465 | 4391 | 4410 | TGAGGCTCAAAGCACTTCTC | 18 | 246 |
| 1131018 | 489 | 508 | 4434 | 4453 | AGTTCTATACCATATCTCAT | 13 | 247 |
| 1131046 | 532 | 551 | 4477 | 4496 | CATCAGGACCCTTGCACTGG | 26 | 248 |
| 1131074 | 566 | 585 | N/A | N/A | CGGCAGGCCTGGCTGGCCAG | 70 | 249 |
| 1131102 | 606 | 625 | 4690 | 4709 | CACCTCTAGGCAGCGACCCC | 28 | 250 |
| 1131130 | 653 | 672 | 4737 | 4756 | AAGGCTCCGGTGTAGCCCAC | 66 | 251 |
| 1131158 | 709 | 728 | 4938 | 4957 | CGCGGTAGCTGAGCCCGCGG | 98 | 252 |
| 1131186 | 762 | 781 | 4991 | 5010 | CTCCGAGGCCCACGGCTGAC | 40 | 253 |
| 1131214 | 839 | 858 | N/A | N/A | TCCGGGTTCCGGCAGAAGGC | 39 | 55 |
| 1131242 | 902 | 921 | 5216 | 5235 | TCGCAGTACTCCCAGCTCAG | 16 | 254 |
| 1131270 | 993 | 1012 | 5307 | 5326 | TGCCGGCTGCGCGGGCATGA | 41 | 255 |
| 1131298 | 1071 | 1090 | 5490 | 5509 | CTGCTCCCGCTTCGCCGGCA | 27 | 256 |
| 1131326 | 1116 | 1135 | 5535 | 5554 | CCGCTGCCCGCAGCTCAGTG | 34 | 257 |
| 1131354 | 1152 | 1171 | 5571 | 5590 | AACGACGCGGGTCATCGAAG | 36 | 258 |
| 1131382 | 1224 | 1243 | 5643 | 5662 | GGCGCAGAAACTGTGGCCCC | 59 | 259 |
| 1131410 | 1311 | 1330 | 5971 | 5990 | GAGCACCACCGTCAGATCCT | 18 | 260 |
| 1131438 | 1380 | 1399 | 6040 | 6059 | GTGCAAGCGGTAGGAGCGCA | 40 | 261 |
| 1131466 | 1459 | 1478 | 6202 | 6221 | GCGCGCAGCTGCCGTCCGCA | 36 | 262 |
| 1131494 | 1548 | 1567 | 6291 | 6310 | GCCCCAGCCGGCCACCTGGC | 62 | 263 |
| 1131522 | 1578 | 1597 | N/A | N/A | GGCATATTCCTCCGCCCCCT | 79 | 264 |
| 1131550 | 1620 | 1639 | 6918 | 6937 | CTCCAGGGAGAGGAACGGTA | 74 | 265 |
| 1131578 | 1746 | 1765 | 7134 | 7153 | TTGGTCCTCACACACCAGCG | 8† | 266 |
| 1131606 | 1793 | 1812 | 7181 | 7200 | GATCCCCAGCTGATGATGCC | 31 | 267 |
| 1131634 | 1823 | 1842 | 7211 | 7230 | ACGCCTGGCTTGTTGCGGTC | 31 | 268 |
| 1131662 | 1870 | 1889 | 7258 | 7277 | CGGTGTGCTCCCGGATCCAG | 22 | 269 |
| 1131690 | 1915 | 1934 | 7303 | 7322 | GGAATCACCAAGGAGGGAAA | 20 | 270 |
| 1131718 | 1950 | 1969 | 7338 | 7357 | TCTTGCCTTCCATGCCCCAG | 17 | 271 |
| 1131746 | 2005 | 2024 | 7393 | 7412 | GAGTTCCTGCGCCATCCTGG | 7 | 159 |

TABLE 35-continued

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131774 | N/A | N/A | 94 | 113 | CACTCACCGAAAGTGTTGAC | 78 | 272 |
| 1131802 | N/A | N/A | 178 | 197 | CCACAGGTCATGAGCAGAGG | 58 | 273 |
| 1131830 | N/A | N/A | 274 | 293 | TGCCCTTGTATCCACCCAGT | 97 | 274 |
| 1131858 | N/A | N/A | 368 | 387 | CCCAGAAATGCAGAGATTTC | 98 | 275 |
| 1131886 | N/A | N/A | 457 | 476 | AATCTACAAGGGAGAGAAGA | 79 | 276 |
| 1131914 | N/A | N/A | 603 | 622 | GGCACTAGACTAGACTGCCC | 67 | ?77 |
| 1131942 | N/A | N/A | 690 | 709 | CTTAGACACAGCCCATACCC | 60 | 278 |
| 1131970 | N/A | N/A | 859 | 878 | ATTGAAGGCCCTGGCCTCTG | 62 | 279 |
| 1131998 | N/A | N/A | 957 | 976 | TCAAATCCCTCGCCCAGAGT | 81 | 280 |
| 1132026 | N/A | N/A | 1064 | 1083 | CAGGTGATGGGCTGAATACC | 81 | 281 |
| 1132054 | N/A | N/A | 1197 | 1216 | AATTTAGTGTCTGGAAGAAT | 70 | 282 |
| 1132082 | N/A | N/A | 1575 | 1594 | CCCCACCAAGTCAGGCCCAC | 78 | 283 |
| 1132110 | N/A | N/A | 1747 | 1766 | TGGACGGACAGAGAGGAGGG | 71 | 284 |
| 1132138 | N/A | N/A | 2123 | 2142 | AGGACCAAACCAGAACTAGG | 58 | 285 |
| 1132166 | N/A | N/A | 2253 | 2272 | TGTCTTCTTCAGAGGAATTG | 66 | 286 |
| 1132194 | N/A | N/A | 2341 | 2360 | GGCTCACAGGAACCTAATAC | 47 | 287 |
| 1132222 | N/A | N/A | 2479 | 2498 | GATTCAGGTGTGTGCTATAG | 53 | 288 |
| 1132250 | N/A | N/A | 2609 | 2628 | GTTTTTCACACTTTGTGCTT | 51 | 289 |
| 1132278 | N/A | N/A | 2734 | 2753 | GGGCATGCACAGAGCAGTGA | 52 | 290 |
| 1132306 | N/A | N/A | 2832 | 2851 | CTCATTCTTCTCTGGTTCTA | 48 | 291 |
| 1132334 | N/A | N/A | 2939 | 2958 | TAGGCACTTAATAATACTTG | 56 | 292 |
| 1132362 | N/A | N/A | 3042 | 3061 | GGAGTCAGATAGCTGGAGTA | 69 | 293 |
| 1132390 | N/A | N/A | 3436 | 3455 | CTCAGGGTCTGGTCAGGAAA | 70 | 294 |
| 1132418 | N/A | N/A | 3631 | 3650 | CAGGCCCCTGCTCCAACTCC | 65 | 295 |
| 1132446 | N/A | N/A | 3743 | 3762 | GAGACAAGGCTTCCCTGCTC | 71 | 296 |
| 1132474 | N/A | N/A | 3889 | 3908 | GATACCAGGAGAGTAATGAG | 55 | 297 |
| 1132502 | N/A | N/A | 4015 | 4034 | AAGCTTGGTTTACCCACCTG | 46 | 298 |
| 1132530 | N/A | N/A | 4122 | 4141 | GAGAGATGGACATGGTGGAA | 67 | 299 |
| 1132558 | N/A | N/A | 4310 | 4329 | CCAGCAACCTATTCTGTAGG | 56 | 300 |
| 1132586 | N/A | N/A | 4535 | 4554 | CTCCCTGGCCCGTTCCCAAC | 68 | 301 |
| 1132614 | N/A | N/A | 4632 | 4651 | AACGCAGTGAGCCACCCCTG | 32 | 302 |
| 1132642 | N/A | N/A | 4859 | 4878 | CTGGGCTCTCCTGCCTCCCT | 31 | 303 |
| 1132670 | N/A | N/A | 5383 | 5402 | TTCCCCCCCCACTTCCTAA | 106 | 304 |
| 1132698 | N/A | N/A | 5751 | 5770 | GAGACGGAGGAGCCGCGGCC | 72 | 305 |
| 1132726 | N/A | N/A | 6158 | 6177 | AACCCGGGCGGAGAGGAGCG | 98 | 306 |

TABLE 35-continued

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132754 | N/A | N/A | 6373 | 6392 | GGCTTCTTCCGCCTAACCCA | 72 | 307 |
| 1132782 | N/A | N/A | 6481 | 6500 | TGAATCCCAGGCCCTGGGAT | 101 | 308 |
| 1132810 | N/A | N/A | 6621 | 6640 | GAGTCGCAGAACCTGGCTCC | 71 | 309 |
| 1132838 | N/A | N/A | 6712 | 6731 | ATTTCATAGGCAAGGAGGCT | 66 | 310 |
| 1132866 | N/A | N/A | 6839 | 6858 | CTTCACACCCCATCTGACAA | 108 | 311 |
| 1132894 | N/A | N/A | 7106 | 7125 | GAATCACCCTGGGTCGGAAA | 76† | 312 |

TABLE 36

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130794 | 79 | 98 | 79 | 98 | TTGACTCCAAGCTCACCAGC | 41 | 315 |
| 1130822 | 136 | 155 | 503 | 522 | GCTCTTCAGCTTTGTACTTA | 34 | 316 |
| 1130850 | 172 | 191 | 3523 | 3542 | GGCAGGGCTCCCCGGTGACA | 19 | 317 |
| 1130871 | 216 | 235 | 3567 | 3586 | GGTACATTTGTGGTACAGCT | 12 | 183 |
| 1130879 | 226 | 245 | 3577 | 3596 | GGCCCTTGTGGGTACATTTG | 66 | 318 |
| 1130907 | 292 | 311 | 3799 | 3818 | AGTATCCCCATCGCTGGTCC | 19 | 319 |
| 1130935 | 332 | 351 | N/A | N/A | TGTTTGCTGCAGTGGTCTTT | 27 | 320 |
| 1130963 | 405 | 424 | 4213 | 4232 | GAGGTGTTGTGGACAGAGAC | 47 | 321 |
| 1130991 | 447 | 466 | 4392 | 4411 | CTGAGGCTCAAAGCACTTCT | 29 | 322 |
| 1131019 | 493 | 512 | 4438 | 4457 | GCTCAGTTCTATACCATATC | 17 | 323 |
| 1131047 | 533 | 552 | 4478 | 4497 | GCATCAGGACCCTTGCACTG | 26 | 324 |
| 1131075 | 568 | 587 | N/A | N/A | TGCGGCAGGCCTGGCTGGCC | 50 | 325 |
| 1131103 | 607 | 626 | 4691 | 4710 | CCACCTCTAGGCAGCGACCC | 29 | 326 |
| 1131131 | 654 | 673 | 4738 | 4757 | GAAGGCTCCGGTGTAGCCCA | 56 | 327 |
| 1131159 | 710 | 729 | 4939 | 4958 | CCGCGGTAGCTGAGCCCGCG | 77 | 328 |
| 1131187 | 763 | 782 | 4992 | 5011 | CCTCCGAGGCCCACGGCTGA | 47 | 329 |
| 1131215 | 840 | 859 | N/A | N/A | GTCCGGGTTCCGGCAGAAGG | 38 | 313 |
| 1131243 | 903 | 922 | 5217 | 5236 | GTCGCAGTACTCCCAGCTCA | 12 | 330 |
| 1131271 | 994 | 1013 | 5308 | 5327 | GTGCCGGCTGCGCGGGCATG | 63 | 331 |
| 1131299 | 1072 | 1091 | 5491 | 5510 | GCTGCTCCCGCTTCGCCGGC | 26 | 332 |
| 1131327 | 1117 | 1136 | 5536 | 5555 | GCCGCTGCCCGCAGCTCAGT | 30 | 333 |
| 1131355 | 1153 | 1172 | 5572 | 5591 | CAACGACGCGGGTCATCGAA | 53 | 334 |
| 1131383 | 1225 | 1244 | 5644 | 5663 | CGGCGCAGAAACTGTGGCCC | 46 | 335 |

TABLE 36-continued

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131411 | 1312 | 1331 | 5972 | 5991 | CGAGCACCACCGTCAGATCC | 17 | 336 |
| 1131439 | 1381 | 1400 | 6041 | 6060 | CGTGCAAGCGGTAGGAGCGC | 27 | 337 |
| 1131467 | 1460 | 1479 | 6203 | 6222 | AGCGCGCAGCTGCCGTCCGC | 42 | 338 |
| 1131495 | 1549 | 1568 | 6292 | 6311 | GGCCCCAGCCGGCCACCTGG | 82 | 339 |
| 1131523 | 1579 | 1598 | N/A | N/A | TGGCATATTCCTCCGCCCCC | 67 | 340 |
| 1131551 | 1621 | 1640 | 6919 | 6938 | GCTCCAGGGAGAGGAACGGT | 66 | 341 |
| 1131579 | 1747 | 1766 | 7135 | 7154 | CTTGGTCCTCACACACCAGC | 36† | 342 |
| 1131607 | 1794 | 1813 | 7182 | 7201 | CGATCCCCAGCTGATGATGC | 41 | 343 |
| 1131635 | 1839 | 1858 | 7227 | 7246 | GGCCACATCGGTGTAGACGC | 18 | 86 |
| 1131663 | 1871 | 1890 | 7259 | 7278 | ACGGTGTGCTCCCGGATCCA | 16 | 344 |
| 1131691 | 1916 | 1935 | 7304 | 7323 | CGGAATCACCAAGGAGGGAA | 15 | 345 |
| 1131719 | 1951 | 1970 | 7339 | 7358 | ATCTTGCCTTCCATGCCCCA | 28 | 346 |
| 1131747 | 2006 | 2025 | 7394 | 7413 | TGAGTTCCTGCGCCATCCTG | 17 | 347 |
| 1131775 | N/A | N/A | 97 | 116 | CAGCACTCACCGAAAGTGTT | 84 | 348 |
| 1131803 | N/A | N/A | 181 | 200 | GACCCACAGGTCATGAGCAG | 87 | 349 |
| 1131831 | N/A | N/A | 277 | 296 | CTGTGCCCTTGTATCCACCC | 61 | 350 |
| 1131859 | N/A | N/A | 371 | 390 | CAGCCCAGAAATGCAGAGAT | 69 | 351 |
| 1131887 | N/A | N/A | 460 | 479 | TGGAATCTACAAGGGAGAGA | 89 | 352 |
| 1131915 | N/A | N/A | 606 | 625 | GTAGGCACTAGACTAGACTG | 52 | 353 |
| 1131943 | N/A | N/A | 693 | 712 | GCACTTAGACACAGCCCATA | 64 | 354 |
| 1131971 | N/A | N/A | 862 | 881 | CCCATTGAAGGCCCTGGCCT | 49 | 355 |
| 1131999 | N/A | N/A | 960 | 979 | AACTCAAATCCCTCGCCCAG | 59 | 356 |
| 1132027 | N/A | N/A | 1067 | 1086 | CACCAGGTGATGGGCTGAAT | 49 | 357 |
| 1132055 | N/A | N/A | 1200 | 1219 | GGTAATTTAGTGTCTGGAAG | 46 | 358 |
| 1132083 | N/A | N/A | 1578 | 1597 | CAACCCCACCAAGTCAGGCC | 69 | 359 |
| 1132111 | N/A | N/A | 1750 | 1769 | GGATGGACGGACAGAGAGGA | 63 | 360 |
| 1132139 | N/A | N/A | 2126 | 2145 | CCAAGGACCAAACCAGAACT | 56 | 361 |
| 1132167 | N/A | N/A | 2256 | 2275 | CTGTGTCTTCTTCAGAGGAA | 50 | 362 |
| 1132195 | N/A | N/A | 2370 | 2389 | TGTTGGTTGATGAAAATGTT | 54 | 363 |
| 1132223 | N/A | N/A | 2482 | 2501 | CTTGATTCAGGTGTGTGCTA | 50 | 364 |
| 1132251 | N/A | N/A | 2628 | 2647 | TCAGTCTACTTAGTGCAACG | 51 | 365 |
| 1132279 | N/A | N/A | 2739 | 2758 | TTTGTGGGCATGCACAGAGC | 53 | 366 |
| 1132307 | N/A | N/A | 2835 | 2854 | ATCCTCATTCTTCTCTGGTT | 53 | 367 |
| 1132335 | N/A | N/A | 2942 | 2961 | AAGTAGGCACTTAATAATAC | 67 | 368 |
| 1132363 | N/A | N/A | 3045 | 3064 | TCAGGAGTCAGATAGCTGGA | 77 | 369 |

TABLE 36-continued

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132391 | N/A | N/A | 3439 | 3458 | TCCCTCAGGGTCTGGTCAGG | 54 | 370 |
| 1132419 | N/A | N/A | 3637 | 3656 | GTCTCCCAGGCCCCTGCTCC | 56 | 371 |
| 1132447 | N/A | N/A | 3749 | 3768 | TAGAAAGAGACAAGGCTTCC | 61 | 372 |
| 1132475 | N/A | N/A | 3892 | 3911 | GGTGATACCAGGAGAGTAAT | 47 | 373 |
| 1132503 | N/A | N/A | 4018 | 4037 | TCCAAGCTTGGTTTACCCAC | 38 | 374 |
| 1132531 | N/A | N/A | 4125 | 4144 | TCTGAGAGATGGACATGGTG | 68 | 375 |
| 1132559 | N/A | N/A | 4313 | 4332 | TATCCAGCAACCTATTCTGT | 69 | 376 |
| 1132587 | N/A | N/A | 4538 | 4557 | CTCCTCCCTGGCCCGTTCCC | 70 | 377 |
| 1132615 | N/A | N/A | 4635 | 4654 | GGGAACGCAGTGAGCCACCC | 49 | 378 |
| 1132643 | N/A | N/A | 4862 | 4881 | AGGCTGGGCTCTCCTGCCTC | 75 | 379 |
| 1132671 | N/A | N/A | 5386 | 5405 | TCCTTCCCCCCCCCACTTCC | 92 | 380 |
| 1132699 | N/A | N/A | 5754 | 5773 | TGGGAGACGGAGGAGCCGCG | 61 | 381 |
| 1132727 | N/A | N/A | 6161 | 6180 | GCTAACCCGGGCGGAGAGGA | 101 | 382 |
| 1132755 | N/A | N/A | 6376 | 6395 | GCGGGCTTCTTCCGCCTAAC | 56 | 383 |
| 1132783 | N/A | N/A | 6484 | 6503 | CAGTGAATCCCAGGCCCTGG | 66 | 384 |
| 1132811 | N/A | N/A | 6624 | 6643 | CCAGAGTCGCAGAACCTGGC | 56 | 385 |
| 1132839 | N/A | N/A | 6715 | 6734 | TCAATTTCATAGGCAAGGAG | 64 | 386 |
| 1132867 | N/A | N/A | 6842 | 6861 | CTTCTTCACACCCCATCTGA | 88 | 387 |
| 1132895 | N/A | N/A | 7109 | 7128 | CCGGAATCACCCTGGGTCGG | 28† | 388 |

TABLE 37

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130795 | 80 | 99 | 80 | 99 | GTTGACTCCAAGCTCACCAG | 40 | 389 |
| 1130823 | 138 | 157 | 505 | 524 | GTGCTCTTCAGCTTTGTACT | 38 | 390 |
| 1130851 | 174 | 193 | 3525 | 3544 | GTGGCAGGGCTCCCCGGTGA | 80 | 391 |
| 1130871 | 216 | 235 | 3567 | 3586 | GGTACATTTGTGGTACAGCT | 11 | 183 |
| 1130880 | 228 | 247 | 3579 | 3598 | CCGGCCCTTGTGGGTACATT | 42 | 392 |
| 1130908 | 293 | 312 | 3800 | 3819 | CAGTATCCCCATCGCTGGTC | 24 | 393 |
| 1130936 | 333 | 352 | N/A | N/A | GTGTTTGCTGCAGTGGTCTT | 32 | 394 |
| 1130964 | 406 | 425 | 4214 | 4233 | TGAGGTGTTGTGGACAGAGA | 112 | 395 |
| 1130992 | 449 | 468 | 4394 | 4413 | AGCTGAGGCTCAAAGCACTT | 45 | 396 |
| 1131020 | 494 | 513 | 4439 | 4458 | TGCTCAGTTCTATACCATAT | 23 | 397 |

TABLE 37-continued

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
| --- | --- | --- | --- | --- | --- | --- | --- |
| 1131048 | 535 | 554 | 4480 | 4499 | GGGCATCAGGACCCTTGCAC | 81 | 398 |
| 1131076 | 569 | 588 | N/A | N/A | GTGCGGCAGGCCTGGCTGGC | 54 | 399 |
| 1131104 | 609 | 628 | 4693 | 4712 | CTCCACCTCTAGGCAGCGAC | 45 | 400 |
| 1131132 | 655 | 674 | 4739 | 4758 | AGAAGGCTCCGGTGTAGCCC | 69 | 401 |
| 1131160 | 711 | 730 | 4940 | 4959 | GCCGCGGTAGCTGAGCCCGC | 97 | 402 |
| 1131188 | 765 | 784 | 4994 | 5013 | GGCCTCCGAGGCCCACGGCT | 45 | 403 |
| 1131216 | 843 | 862 | N/A | N/A | GTTGTCCGGGTTCCGGCAGA | 20 | 404 |
| 1131244 | 904 | 923 | 5218 | 5237 | GGTCGCAGTACTCCCAGCTC | 32 | 405 |
| 1131272 | 996 | 1015 | 5310 | 5329 | CGGTGCCGGCTGCGCGGGCA | 59 | 406 |
| 1131300 | 1073 | 1092 | 5492 | 5511 | GGCTGCTCCCGCTTCGCCGG | 50 | 407 |
| 1131328 | 1118 | 1137 | 5537 | 5556 | AGCCGCTGCCCGCAGCTCAG | 83 | 408 |
| 1131356 | 1155 | 1174 | 5574 | 5593 | GCCAACGACGCGGGTCATCG | 38 | 409 |
| 1131384 | 1227 | 1246 | 5646 | 5665 | GCCGGCGCAGAAACTGTGGC | 68 | 410 |
| 1131412 | 1313 | 1332 | 5973 | 5992 | CCGAGCACCACCGTCAGATC | 47 | 411 |
| 1131440 | 1399 | 1418 | 6059 | 6078 | TGACGGGCGAGAAGGCCTCG | 59 | 412 |
| 1131468 | 1462 | 1481 | 6205 | 6224 | GGAGCGCGCAGCTGCCGTCC | 44 | 413 |
| 1131496 | 1550 | 1569 | 6293 | 6312 | TGGCCCCAGCCGGCCACCTG | 96 | 414 |
| 1131524 | 1581 | 1600 | 6879 | 6898 | GCTGGCATATTCCTCCGCCC | 64 | 415 |
| 1131552 | 1622 | 1641 | 6920 | 6939 | CGCTCCAGGGAGAGGAACGG | 107 | 416 |
| 1131580 | 1748 | 1767 | 7136 | 7155 | GCTTGGTCCTCACACACCAG | 10† | 80 |
| 1131608 | 1795 | 1814 | 7183 | 7202 | CCGATCCCCAGCTGATGATG | 28 | 417 |
| 1131636 | 1842 | 1861 | 7230 | 7249 | GTAGGCCACATCGGTGTAGA | 51 | 418 |
| 1131664 | 1873 | 1892 | 7261 | 7280 | AAACGGTGTGCTCCCGGATC | 81 | 419 |
| 1131692 | 1917 | 1936 | 7305 | 7324 | GCGGAATACCAAGGAGGGA | 18 | 420 |
| 1131720 | 1952 | 1971 | 7340 | 7359 | AATCTTGCCTTCCATGCCCC | 30 | 421 |
| 1131748 | 2007 | 2026 | 7395 | 7414 | TTGAGTTCCTGCGCCATCCT | 11 | 422 |
| 1131776 | N/A | N/A | 100 | 119 | CCACAGCACTCACCGAAAGT | 116 | 423 |
| 1131804 | N/A | N/A | 184 | 203 | CTGGACCCACAGGTCATGAG | 48 | 424 |
| 1131832 | N/A | N/A | 280 | 299 | AGGCTGTGCCCTTGTATCCA | 45 | 425 |
| 1131860 | N/A | N/A | 374 | 393 | TCACAGCCCAGAAATGCAGA | 144 | 426 |
| 1131888 | N/A | N/A | 463 | 482 | AGGTGGAATCTACAAGGGAG | 72 | 427 |
| 1131916 | N/A | N/A | 609 | 628 | CAGGTAGGCACTAGACTAGA | 85 | 428 |
| 1131944 | N/A | N/A | 696 | 715 | TGGGCACTTAGACACAGCCC | 56 | 429 |
| 1131972 | N/A | N/A | 865 | 884 | TTGCCCATTGAAGGCCCTGG | 60 | 430 |
| 1132000 | N/A | N/A | 963 | 982 | GAGAACTCAAATCCCTCGCC | 77 | 431 |

TABLE 37-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132028 | N/A | N/A | 1070 | 1089 | ATGCACCAGGTGATGGGCTG | 65 | 432 |
| 1132056 | N/A | N/A | 1203 | 1222 | GTAGGTAATTTAGTGTCTGG | 89 | 433 |
| 1132084 | N/A | N/A | 1581 | 1600 | ACTCAACCCCACCAAGTCAG | 75 | 434 |
| 1132112 | N/A | N/A | 1753 | 1772 | ATGGGATGGACGGACAGAGA | 60 | 435 |
| 1132140 | N/A | N/A | 2129 | 2148 | TTGCCAAGGACCAAACCAGA | 87 | 436 |
| 1132168 | N/A | N/A | 2259 | 2278 | TGCCTGTGTCTTCTTCAGAG | 51 | 437 |
| 1132196 | N/A | N/A | 2373 | 2392 | TGCTGTTGGTTGATGAAAAT | 51 | 438 |
| 1132224 | N/A | N/A | 2485 | 2504 | ACACTTGATTCAGGTGTGTG | 64 | 439 |
| 1132252 | N/A | N/A | 2634 | 2653 | TCCTTCTCAGTCTACTTAGT | 53 | 440 |
| 1132280 | N/A | N/A | 2742 | 2761 | CCATTTGTGGGCATGCACAG | 60 | 441 |
| 1132308 | N/A | N/A | 2838 | 2857 | TTGATCCTCATTCTTCTCTG | 44 | 442 |
| 1132336 | N/A | N/A | 2950 | 2969 | TTGCCACAAAGTAGGCACTT | 66 | 443 |
| 1132364 | N/A | N/A | 3048 | 3067 | GGTTCAGGAGTCAGATAGCT | 74 | 444 |
| 1132392 | N/A | N/A | 3442 | 3461 | CTGTCCCTCAGGGTCTGGTC | 74 | 445 |
| 1132420 | N/A | N/A | 3640 | 3659 | CATGTCTCCCAGGCCCTGC | 49 | 446 |
| 1132448 | N/A | N/A | 3752 | 3771 | CTGTAGAAAGAGACAAGGCT | 52 | 447 |
| 1132476 | N/A | N/A | 3895 | 3914 | TCTGGTGATACCAGGAGAGT | 50 | 448 |
| 1132504 | N/A | N/A | 4021 | 4040 | GTTTCCAAGCTTGGTTTACC | 61 | 449 |
| 1132532 | N/A | N/A | 4128 | 4147 | TGGTCTGAGAGATGGACATG | 40 | 450 |
| 1132560 | N/A | N/A | 4316 | 4335 | GAGTATCCAGCAACCTATTC | 46 | 451 |
| 1132588 | N/A | N/A | 4541 | 4560 | ACGCTCCTCCCTGGCCCGTT | 85 | 452 |
| 1132616 | N/A | N/A | 4638 | 4657 | GGAGGGAACGCAGTGAGCCA | 83 | 453 |
| 1132644 | N/A | N/A | 4866 | 4885 | GCCAAGGCTGGGCTCTCCTG | 43 | 454 |
| 1132672 | N/A | N/A | 5389 | 5408 | TCCTCCTTCCCCCCCCCACT | 99 | 455 |
| 1132700 | N/A | N/A | 5757 | 5776 | CGCTGGGAGACGGAGGAGCC | 98 | 456 |
| 1132728 | N/A | N/A | 6164 | 6183 | AGAGCTAACCCGGGCGGAGA | 69 | 457 |
| 1132756 | N/A | N/A | 6379 | 6398 | GTCGCGGGCTTCTTCCGCCT | 46 | 458 |
| 1132784 | N/A | N/A | 6487 | 6506 | CAGCAGTGAATCCCAGGCCC | 63 | 459 |
| 1132812 | N/A | N/A | 6627 | 6646 | CATCCAGAGTCGCAGAACCT | 48 | 460 |
| 1132840 | N/A | N/A | 6718 | 6737 | AATTCAATTTCATAGGCAAG | 69 | 461 |
| 1132868 | N/A | N/A | 6845 | 6864 | CGCCTTCTTCACACCCCATC | 97 | 462 |
| 1132896 | N/A | N/A | 7112 | 7131 | CCTCCGGAATCACCCTGGGT | 53† | 463 |

TABLE 38

Reduction of FXII RNA by 5-10-5 MOE gapmers with mixed PO/PS internucleoside linkages
(Huh7, electroporation 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130796 | 82 | 101 | 82 | 101 | GTGTTGACTCCAAGCTCACC | 34 | 465 |
| 1130824 | 139 | 158 | 506 | 525 | TGTGCTCTTCAGCTTTGTAC | 21 | 466 |
| 1130852 | 175 | 194 | 3526 | 3545 | AGTGGCAGGGCTCCCCGGTG | 59 | 467 |
| 1130871 | 216 | 235 | 3567 | 3586 | GGTACATTTGTGGTACAGCT | 16 | 183 |
| 1130881 | 229 | 248 | 3580 | 3599 | GCCGGCCCTTGTGGGTACAT | 52 | 468 |
| 1130909 | 294 | 313 | 3801 | 3820 | ACAGTATCCCCATCGCTGGT | 46 | 469 |
| 1130937 | 334 | 353 | 4142 | 4161 | TGTGTTTGCTGCAGTGGTCT | 63 | 470 |
| 1130965 | 407 | 426 | 4215 | 4234 | GTGAGGTGTTGTGGACAGAG | 40 | 471 |
| 1130993 | 450 | 469 | 4395 | 4414 | AAGCTGAGGCTCAAAGCACT | 37 | 472 |
| 1131021 | 495 | 514 | 4440 | 4459 | TTGCTCAGTTCTATACCATA | 16 | 473 |
| 1131049 | 536 | 555 | 4481 | 4500 | TGGGCATCAGGACCCTTGCA | 47 | 474 |
| 1131077 | 570 | 589 | N/A | N/A | GGTGCGGCAGGCCTGGCTGG | 52 | 475 |
| 1131105 | 610 | 629 | 4694 | 4713 | CCTCCACCTCTAGGCAGCGA | 48 | 476 |
| 1131133 | 656 | 675 | 4740 | 4759 | CAGAAGGCTCCGGTGTAGCC | 89 | 477 |
| 1131161 | 712 | 731 | 4941 | 4960 | GGCCGCGGTAGCTGAGCCCG | 59 | 478 |
| 1131189 | 766 | 785 | 4995 | 5014 | TGGCCTCCGAGGCCCACGGC | 75 | 479 |
| 1131217 | 844 | 863 | N/A | N/A | CGTTGTCCGGGTTCCGGCAG | 32 | 480 |
| 1131245 | 905 | 924 | 5219 | 5238 | AGGTCGCAGTACTCCCAGCT | 37 | 481 |
| 1131273 | 997 | 1016 | 5311 | 5330 | GCGGTGCCGGCTGCGCGGGC | 49 | 482 |
| 1131301 | 1075 | 1094 | 5494 | 5513 | GCGGCTGCTCCCGCTTCGCC | 48 | 483 |
| 1131329 | 1120 | 1139 | 5539 | 5558 | GGAGCCGCTGCCCGCAGCTC | 51 | 484 |
| 1131357 | 1156 | 1175 | 5575 | 5594 | CGCCAACGACGCGGGTCATC | 23 | 485 |
| 1131385 | 1228 | 1247 | 5647 | 5666 | TGCCGGCGCAGAAACTGTGG | 61 | 486 |
| 1131413 | 1314 | 1333 | 5974 | 5993 | GCCGAGCACCACCGTCAGAT | 35 | 487 |
| 1131441 | 1400 | 1419 | 6060 | 6079 | CTGACGGGCGAGAAGGCCTC | 37 | 488 |
| 1131469 | 1463 | 1482 | 6206 | 6225 | AGGAGCGCGCAGCTGCCGTC | 77 | 464 |
| 1131497 | 1551 | 1570 | 6294 | 6313 | GTGGCCCCAGCCGGCCACCT | 114 | 489 |
| 1131525 | 1582 | 1601 | 6880 | 6899 | AGCTGGCATATTCCTCCGCC | 113 | 490 |
| 1131553 | 1623 | 1642 | 6921 | 6940 | GCGCTCCAGGGAGAGGAACG | 90 | 491 |
| 1131581 | 1749 | 1768 | 7137 | 7156 | AGCTTGGTCCTCACACACCA | 7† | 492 |
| 1131609 | 1796 | 1815 | 7184 | 7203 | CCCGATCCCCAGCTGATGAT | 33 | 493 |
| 1131637 | 1843 | 1862 | 7231 | 7250 | AGTAGGCCACATCGGTGTAG | 37 | 494 |
| 1131665 | 1874 | 1893 | 7262 | 7281 | GAAACGGTGTGCTCCCGGAT | 36 | 495 |
| 1131693 | 1918 | 1937 | 7306 | 7325 | TGCGGAATCACCAAGGAGGG | 11 | 496 |
| 1131721 | 1954 | 1973 | 7342 | 7361 | ACAATCTTGCCTTCCATGCC | 25 | 497 |
| 1131749 | 2009 | 2028 | 7397 | 7416 | TATTGAGTTCCTGCGCCATC | 13 | 498 |

TABLE 38-continued

Reduction of FXII RNA by 5-10-5 MOE gapmers with mixed PO/PS internucleoside linkages (Huh7, electroporation 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131777 | N/A | N/A | 103 | 122 | TTCCCACAGCACTCACCGAA | 77 | 499 |
| 1131805 | N/A | N/A | 187 | 206 | CACCTGGACCCACAGGTCAT | 88 | 500 |
| 1131833 | N/A | N/A | 283 | 302 | TGCAGGCTGTGCCCTTGTAT | 115 | 501 |
| 1131861 | N/A | N/A | 377 | 396 | CTCTCACAGCCCAGAAATGC | 73 | 502 |
| 1131889 | N/A | N/A | 466 | 485 | CCAAGGTGGAATCTACAAGG | 30 | 503 |
| 1131917 | N/A | N/A | 612 | 631 | CACCAGGTAGGCACTAGACT | 42 | 504 |
| 1131945 | N/A | N/A | 716 | 735 | CCTGCTCCGAGCCAGGCTCG | 62 | 505 |
| 1131973 | N/A | N/A | 868 | 887 | TCCTTGCCCATTGAAGGCCC | 43 | 506 |
| 1132001 | N/A | N/A | 966 | 985 | TTGGAGAACTCAAATCCCTC | 52 | 507 |
| 1132029 | N/A | N/A | 1073 | 1092 | TCCATGCACCAGGTGATGGG | 54 | 508 |
| 1132057 | N/A | N/A | 1206 | 1225 | CATGTAGGTAATTTAGTGTC | 47 | 509 |
| 1132085 | N/A | N/A | 1584 | 1603 | GAGACTCAACCCCACCAAGT | 60 | 510 |
| 1132113 | N/A | N/A | 1756 | 1775 | CAGATGGGATGGACGGACAG | 74 | 511 |
| 1132141 | N/A | N/A | 2132 | 2151 | CACTTGCCAAGGACCAAACC | 69 | 512 |
| 1132169 | N/A | N/A | 2262 | 2281 | AATTGCCTGTGTCTTCTTCA | 51 | 513 |
| 1132197 | N/A | N/A | 2376 | 2395 | ATATGCTGTTGGTTGATGAA | 48 | 514 |
| 1132225 | N/A | N/A | 2488 | 2507 | TAGACACTTGATTCAGGTGT | 43 | 515 |
| 1132253 | N/A | N/A | 2637 | 2656 | GTGTCCTTCTCAGTCTACTT | 45 | 516 |
| 1132281 | N/A | N/A | 2745 | 2764 | TGGCCATTTGTGGGCATGCA | 69 | 517 |
| 1132309 | N/A | N/A | 2841 | 2860 | CAGTTGATCCTCATTCTTCT | 57 | 518 |
| 1132337 | N/A | N/A | 2953 | 2972 | CACTTGCCACAAAGTAGGCA | 44 | 519 |
| 1132365 | N/A | N/A | 3051 | 3070 | TTGGGTTCAGGAGTCAGATA | 73 | 520 |
| 1132393 | N/A | N/A | 3445 | 3464 | GCACTGTCCCTCAGGGTCTG | 47 | 521 |
| 1132421 | N/A | N/A | 3643 | 3662 | GTACATGTCTCCCAGGCCCC | 50 | 522 |
| 1132449 | N/A | N/A | 3755 | 3774 | CACCTGTAGAAAGAGACAAG | 58 | 523 |
| 1132477 | N/A | N/A | 3898 | 3917 | GGGTCTGGTGATACCAGGAG | 44 | 524 |
| 1132505 | N/A | N/A | 4024 | 4043 | CAAGTTTCCAAGCTTGGTTT | 29 | 525 |
| 1132533 | N/A | N/A | 4131 | 4150 | CAGTGGTCTGAGAGATGGAC | 46 | 526 |
| 1132561 | N/A | N/A | 4319 | 4338 | TCCGAGTATCCAGCAACCTA | 50 | 527 |
| 1132589 | N/A | N/A | 4557 | 4576 | CCAGCCTGTCTTCCTGACGC | 67 | 528 |
| 1132617 | N/A | N/A | 4657 | 4676 | GTTGGTGCGGCAGGCTTGGG | 59 | 529 |
| 1132645 | N/A | N/A | 4869 | 4888 | GCAGCCAAGGCTGGGCTCTC | 59 | 530 |
| 1132673 | N/A | N/A | 5392 | 5411 | GGCTCCTCCTTCCCCCCCCC | 41 | 531 |
| 1132701 | N/A | N/A | 5760 | 5779 | CTGCGCTGGGAGACGGAGGA | 70 | 532 |
| 1132729 | N/A | N/A | 6167 | 6186 | AACAGAGCTAACCCGGGCGG | 65 | 533 |

TABLE 38-continued

Reduction of FXII RNA by 5-10-5 MOE gapmers with mixed PO/PS internucleoside linkages (Huh7, electroporation 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132757 | N/A | N/A | 6382 | 6401 | AAAGTCGCGGGCTTCTTCCG | 31 | 534 |
| 1132785 | N/A | N/A | 6490 | 6509 | TCCCAGCAGTGAATCCCAGG | 69 | 535 |
| 1132813 | N/A | N/A | 6630 | 6649 | ACCCATCCAGAGTCGCAGAA | 43 | 536 |
| 1132841 | N/A | N/A | 6721 | 6740 | ATTAATTCAATTTCATAGGC | 68 | 537 |
| 1132869 | N/A | N/A | 6862 | 6881 | CCCCTGCGAACACAGAGCGC | 59 | 538 |

TABLE 39

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130797 | 83 | 102 | 83 | 102 | AGTGTTGACTCCAAGCTCAC | 27 | 541 |
| 1130825 | 141 | 160 | 508 | 527 | TGTGTGCTCTTCAGCTTTGT | 14 | 542 |
| 1130853 | 177 | 196 | 3528 | 3547 | GAAGTGGCAGGGCTCCCCGG | 33 | 543 |
| 1130871 | 216 | 235 | 3567 | 3586 | GGTACATTTGTGGTACAGCT | 9 | 183 |
| 1130882 | 231 | 250 | 3582 | 3601 | TGGCCGGCCCTTGTGGGTAC | 23 | 544 |
| 1130910 | 296 | 315 | 3803 | 3822 | AAACAGTATCCCCATCGCTG | 36 | 545 |
| 1130938 | 335 | 354 | 4143 | 4162 | CTGTGTTTGCTGCAGTGGTC | 13 | 546 |
| 1130966 | 408 | 427 | 4216 | 4235 | AGTGAGGTGTTGTGGACAGA | 48 | 547 |
| 1130994 | 451 | 470 | 4396 | 4415 | GAAGCTGAGGCTCAAAGCAC | 22 | 548 |
| 1131022 | 496 | 515 | 4441 | 4460 | CTTGCTCAGTTCTATACCAT | 23 | 549 |
| 1131050 | 537 | 556 | 4482 | 4501 | GTGGGCATCAGGACCCTTGC | 41 | 550 |
| 1131078 | 571 | 590 | N/A | N/A | TGGTGCGGCAGGCCTGGCTG | 33 | 551 |
| 1131106 | 612 | 631 | 4696 | 4715 | GCCCTCCACCTCTAGGCAGC | 26 | 552 |
| 1131134 | 657 | 676 | 4741 | 4760 | GCAGAAGGCTCCGGTGTAGC | 23 | 553 |
| 1131162 | 714 | 733 | 4943 | 4962 | CAGGCCGCGGTAGCTGAGCC | 34 | 554 |
| 1131190 | 767 | 786 | 4996 | 5015 | GTGGCCTCCGAGGCCCACGG | 50 | 555 |
| 1131218 | 862 | 881 | 5176 | 5195 | AGCACCACGGGCGGATGTCG | 25 | 539 |
| 1131246 | 907 | 926 | 5221 | 5240 | CCAGGTCGCAGTACTCCCAG | 26 | 556 |
| 1131274 | 998 | 1017 | 5312 | 5331 | GGCGGTGCCGGCTGCGCGGG | 71 | 557 |
| 1131302 | 1076 | 1095 | 5495 | 5514 | GGCGGCTGCTCCCGCTTCGC | 20 | 558 |
| 1131330 | 1121 | 1140 | 5540 | 5559 | CGGAGCCGCTGCCCGCAGCT | 33 | 559 |
| 1131358 | 1158 | 1177 | 5577 | 5596 | CCCGCCAACGACGCGGGTCA | 19 | 560 |
| 1131386 | 1229 | 1248 | 5648 | 5667 | CTGCCGGCGCAGAAACTGTG | 46 | 561 |
| 1131414 | 1315 | 1334 | 5975 | 5994 | GGCCGAGCACCACCGTCAGA | 32 | 562 |

TABLE 39-continued

Reduction of FXII RNA by 5-10-5 MOE gapmers with mixed PO/PS internucleoside linkages
(Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1131442 | 1401 | 1420 | 6061 | 6080 | GCTGACGGGCGAGAAGGCCT | 19 | 563 |
| 1131470 | 1464 | 1483 | 6207 | 6226 | CAGGAGCGCGCAGCTGCCGT | 33 | 564 |
| 1131498 | 1552 | 1571 | 6295 | 6314 | GGTGGCCCCAGCCGGCCACC | 46 | 565 |
| 1131526 | 1583 | 1602 | 6881 | 6900 | AAGCTGGCATATTCCTCCGC | 136 | 566 |
| 1131554 | 1657 | 1676 | 6955 | 6974 | GGATGGAGGATCCGTGCACG | 15† | 567 |
| 1131582 | 1750 | 1769 | 7138 | 7157 | CAGCTTGGTCCTCACACACC | 11† | 568 |
| 1131610 | 1797 | 1816 | 7185 | 7204 | GCCCGATCCCCAGCTGATGA | 39 | 569 |
| 1131638 | 1844 | 1863 | 7232 | 7251 | TAGTAGGCCACATCGGTGTA | 25 | 87 |
| 1131666 | 1876 | 1895 | 7264 | 7283 | AGGAAACGGTGTGCTCCCGG | 31 | 570 |
| 1131694 | 1919 | 1938 | 7307 | 7326 | CTGCGGAATCACCAAGGAGG | 10 | 571 |
| 1131722 | 1955 | 1974 | 7343 | 7362 | CACAATCTTGCCTTCCATGC | 18 | 572 |
| 1131750 | 2010 | 2029 | 7398 | 7417 | TTATTGAGTTCCTGCGCCAT | 23 | 573 |
| 1131778 | N/A | N/A | 106 | 125 | TGGTTCCCACAGCACTCACC | 42 | 574 |
| 1131806 | N/A | N/A | 190 | 209 | AGTCACCTGGACCCACAGGT | 28 | 575 |
| 1131834 | N/A | N/A | 286 | 305 | AAATGCAGGCTGTGCCCTTG | 33 | 576 |
| 1131862 | N/A | N/A | 380 | 399 | TTCCTCTCACAGCCCAGAAA | 41 | 577 |
| 1131890 | N/A | N/A | 469 | 488 | TTCCCAAGGTGGAATCTACA | 74 | 578 |
| 1131918 | N/A | N/A | 615 | 634 | TAGCACCAGGTAGGCACTAG | 45 | 579 |
| 1131946 | N/A | N/A | 721 | 740 | AAGCACCTGCTCCGAGCCAG | 33 | 580 |
| 1131974 | N/A | N/A | 871 | 890 | CCTTCCTTGCCCATTGAAGG | 46 | 581 |
| 1132002 | N/A | N/A | 969 | 988 | AGCTTGGAGAACTCAAATCC | 56 | 582 |
| 1132030 | N/A | N/A | 1076 | 1095 | ATTTCCATGCACCAGGTGAT | 58 | 583 |
| 1132058 | N/A | N/A | 1209 | 1228 | TGGCATGTAGGTAATTTAGT | 34 | 584 |
| 1132086 | N/A | N/A | 1587 | 1606 | TTAGAGACTCAACCCCACCA | 55 | 585 |
| 1132114 | N/A | N/A | 1759 | 1778 | ATGCAGATGGGATGGACGGA | 48 | 586 |
| 1132142 | N/A | N/A | 2135 | 2154 | GTGCACTTGCCAAGGACCAA | 25 | 587 |
| 1132170 | N/A | N/A | 2265 | 2284 | GAGAATTGCCTGTGTCTTCT | 40 | 588 |
| 1132198 | N/A | N/A | 2379 | 2398 | ATTATATGCTGTTGGTTGAT | 28 | 589 |
| 1132226 | N/A | N/A | 2513 | 2532 | GCTACCTTAGGGAGAAAGCG | 53 | 590 |
| 1132254 | N/A | N/A | 2640 | 2659 | TGAGTGTCCTTCTCAGTCTA | 47 | 591 |
| 1132282 | N/A | N/A | 2748 | 2767 | TCATGGCCATTTGTGGGCAT | 46 | 592 |
| 1132310 | N/A | N/A | 2845 | 2864 | AGTACAGTTGATCCTCATTC | 56 | 593 |
| 1132338 | N/A | N/A | 2956 | 2975 | GAGCACTTGCCACAAAGTAG | 30 | 594 |
| 1132366 | N/A | N/A | 3054 | 3073 | AACTTGGGTTCAGGAGTCAG | 42 | 595 |
| 1132394 | N/A | N/A | 3448 | 3467 | CAGGCACTGTCCCTCAGGGT | 32 | 596 |

TABLE 39-continued

Reduction of FXII RNA by 5-10-5 MOE gapmers with mixed PO/PS internucleoside linkages (Huh7, electroporation, 5000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132422 | N/A | N/A | 3649 | 3668 | GGCAGGGTACATGTCTCCCA | 36 | 597 |
| 1132450 | N/A | N/A | 3758 | 3777 | GCACACCTGTAGAAAGAGAC | 39 | 598 |
| 1132478 | N/A | N/A | 3916 | 3935 | CAGAATCCCAGGTGTGTGGG | 64 | 599 |
| 1132506 | N/A | N/A | 4027 | 4046 | CTCCAAGTTTCCAAGCTTGG | 38 | 600 |
| 1132534 | N/A | N/A | 4134 | 4153 | CTGCAGTGGTCTGAGAGATG | 36 | 601 |
| 1132562 | N/A | N/A | 4325 | 4344 | CAAGTCTCCGAGTATCCAGC | 49 | 602 |
| 1132590 | N/A | N/A | 4560 | 4579 | CTGCCAGCCTGTCTTCCTGA | 30 | 603 |
| 1132618 | N/A | N/A | 4660 | 4679 | CGGGTTGGTGCGGCAGGCTT | 30 | 604 |
| 1132646 | N/A | N/A | 4875 | 4894 | CCCTGGGCAGCCAAGGCTGG | 53 | 605 |
| 1132674 | N/A | N/A | 5395 | 5414 | CTCGGCTCCTCCTTCCCCCC | 45 | 606 |
| 1132702 | N/A | N/A | 5763 | 5782 | AAGCTGCGCTGGGAGACGGA | 45 | 607 |
| 1132730 | N/A | N/A | 6170 | 6189 | CGCAACAGAGCTAACCCGGG | 45 | 608 |
| 1132758 | N/A | N/A | 6385 | 6404 | ACCAAAGTCGCGGGCTTCTT | 43 | 609 |
| 1132786 | N/A | N/A | 6493 | 6512 | GGATCCCAGCAGTGAATCCC | 59 | 610 |
| 1132814 | N/A | N/A | 6633 | 6652 | ACCACCCATCCAGAGTCGCA | 44 | 611 |
| 1132842 | N/A | N/A | 6724 | 6743 | GCCATTAATTCAATTTCATA | 45 | 612 |
| 1132870 | N/A | N/A | 6865 | 6884 | CCGCCCTGCGAACACAGAG | 44 | 613 |

TABLE 40

Reduction of FXII RNA by 5-10-5 MOE gapmers with mixed PO/PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130868 | 213 | 232 | 3564 | 3583 | ACATTTGTGGTACAGCTGCC | 84 | 1756 |
| 1130987 | 443 | 462 | N/A | N/A | GGCTCAAAGCACTTCTCTTT | 93 | 2135 |
| 1131593 | 1780 | 1799 | 7168 | 7187 | TGATGCCTTGCAGGGTGAGC | 37 | 1326 |
| 1131694 | 1919 | 1938 | 7307 | 7326 | CTGCGGAATCACCAAGGAGG | 57 | 571 |
| 1131701 | 1928 | 1947 | 7316 | 7335 | ACTCTCTCACTGCGGAATCA | 42 | 1179 |
| 1131746 | 2005 | 2024 | 7393 | 7412 | GAGTTCCTGCGCCATCCTGG | 40 | 159 |
| 1131754 | 2015 | 2034 | 7403 | 7422 | GCACTTTATTGAGTTCCTGC | 35 | 164 |
| 1131756 | 2017 | 2036 | 7405 | 7424 | AAGCACTTTATTGAGTTCCT | 11 | 1030 |
| 1131757 | 2018 | 2037 | 7406 | 7425 | AAAGCACTTTATTGAGTTCC | 36 | 165 |
| 1131763 | 2026 | 2045 | 7414 | 7433 | GCATTTTCAAAGCACTTTAT | 41 | 1562 |
| 1131891 | N/A | N/A | 513 | 532 | CCGACTGTGTGCTCTTCAGC | 88 | 659 |
| 1132188 | N/A | N/A | 2323 | 2342 | ACTGTTTGCTAGTTCAATGT | 106 | 1951 |

TABLE 40-continued

Reduction of FXII RNA by 5-10-5 MOE gapmers with mixed PO/PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1132271 | N/A | N/A | 2706 | 2725 | CACATTCCCAGTTAAGGTTC | 93 | 1879 |
| 1132505 | N/A | N/A | 4024 | 4043 | CAAGTTTCCAAGCTTGGTTT | 104 | 525 |
| 1132651 | N/A | N/A | 4908 | 4927 | AGCTTGCCTTGGTGTCTGAG | 79 | 985 |
| 1132797 | N/A | N/A | 6542 | 6561 | AGGGAACCAAGAGCAAGTTC | 72 | 1369 |
| 1194299 | N/A | N/A | 2318 | 2337 | TTGCTAGTTCAATGTTCACT | 95 | 2351 |
| 1194300 | N/A | N/A | 2319 | 2338 | TTTGCTAGTTCAATGTTCAC | 67 | 2352 |
| 1194301 | N/A | N/A | 2321 | 2340 | TGTTTGCTAGTTCAATGTTC | 102 | 2353 |
| 1194302 | N/A | N/A | 2322 | 2341 | CTGTTTGCTAGTTCAATGTT | 97 | 2354 |
| 1194303 | N/A | N/A | 2324 | 2343 | TACTGTTTGCTAGTTCAATG | 95 | 2355 |
| 1194304 | N/A | N/A | 2325 | 2344 | ATACTGTTTGCTAGTTCAAT | 97 | 2356 |
| 1194305 | N/A | N/A | 2327 | 2346 | TAATACTGTTTGCTAGTTCA | 96 | 2357 |
| 1194306 | N/A | N/A | 2328 | 2347 | CTAATACTGTTTGCTAGTTC | 93 | 2358 |
| 1194307 | N/A | N/A | 2701 | 2720 | TCCCAGTTAAGGTTCAACAA | 99 | 2359 |
| 1194308 | N/A | N/A | 2702 | 2721 | TTCCCAGTTAAGGTTCAACA | 96 | 2360 |
| 1194309 | N/A | N/A | 2704 | 2723 | CATTCCCAGTTAAGGTTCAA | 79 | 2361 |
| 1194310 | N/A | N/A | 2705 | 2724 | ACATTCCCAGTTAAGGTTCA | 81 | 2362 |
| 1194311 | N/A | N/A | 2707 | 2726 | GCACATTCCCAGTTAAGGTT | 100 | 2363 |
| 1194312 | N/A | N/A | 2708 | 2727 | TGCACATTCCCAGTTAAGGT | 95 | 2364 |
| 1194313 | N/A | N/A | 2710 | 2729 | TTTGCACATTCCCAGTTAAG | 92 | 2365 |
| 1194314 | N/A | N/A | 2711 | 2730 | ATTTGCACATTCCCAGTTAA | 105 | 2366 |
| 1194315 | N/A | N/A | 4019 | 4038 | TTCCAAGCTTGGTTTACCCA | 113 | 2367 |
| 1194316 | N/A | N/A | 4020 | 4039 | TTTCCAAGCTTGGTTTACCC | 109 | 2368 |
| 1194317 | N/A | N/A | 4022 | 4041 | AGTTTCCAAGCTTGGTTTAC | 87 | 2369 |
| 1194318 | N/A | N/A | 4023 | 4042 | AAGTTTCCAAGCTTGGTTTA | 84 | 2370 |
| 1194319 | N/A | N/A | 4025 | 4044 | CCAAGTTTCCAAGCTTGGTT | 102 | 2371 |
| 1194320 | N/A | N/A | 4026 | 4045 | TCCAAGTTTCCAAGCTTGGT | 81 | 2372 |
| 1194321 | N/A | N/A | 4028 | 4047 | ACTCCAAGTTTCCAAGCTTG | 95 | 2373 |
| 1194322 | N/A | N/A | 4029 | 4048 | TACTCCAAGTTTCCAAGCTT | 98 | 2374 |
| 1194323 | N/A | N/A | 4903 | 4922 | GCCTTGGTGTCTGAGGAGAA | 83 | 2375 |
| 1194324 | N/A | N/A | 4904 | 4923 | TGCCTTGGTGTCTGAGGAGA | 80 | 2376 |
| 1194325 | N/A | N/A | 4906 | 4925 | CTTGCCTTGGTGTCTGAGGA | 75 | 2377 |
| 1194326 | N/A | N/A | 4907 | 4926 | GCTTGCCTTGGTGTCTGAGG | 77 | 2378 |
| 1194327 | N/A | N/A | 4909 | 4928 | CAGCTTGCCTTGGTGTCTGA | 78 | 2379 |
| 1194328 | N/A | N/A | 4910 | 4929 | GCAGCTTGCCTTGGTGTCTG | 87 | 2380 |
| 1194329 | 683 | 702 | 4912 | 4931 | TAGCAGCTTGCCTTGGTGTC | 99 | 2381 |

TABLE 40-continued

Reduction of FXII RNA by 5-10-5 MOE gapmers with mixed PO/PS internucleoside linkages
(Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1194330 | 684 | 703 | 4913 | 4932 | ATAGCAGCTTGCCTTGGTGT | 93 | 2382 |
| 1194331 | N/A | N/A | 6537 | 6556 | ACCAAGAGCAAGTTCGATTC | 60 | 2383 |
| 1194332 | N/A | N/A | 6538 | 6557 | AACCAAGAGCAAGTTCGATT | 56 | 2384 |
| 1194333 | N/A | N/A | 6540 | 6559 | GGAACCAAGAGCAAGTTCGA | 73 | 2385 |
| 1194334 | N/A | N/A | 6541 | 6560 | GGGAACCAAGAGCAAGTTCG | 69 | 2386 |
| 1194335 | N/A | N/A | 6543 | 6562 | GAGGGAACCAAGAGCAAGTT | 74 | 2387 |
| 1194336 | N/A | N/A | 6544 | 6563 | AGAGGGAACCAAGAGCAAGT | 69 | 2388 |
| 1194337 | N/A | N/A | 6545 | 6564 | CAGAGGGAACCAAGAGCAAG | 85 | 2389 |
| 1194338 | N/A | N/A | 6546 | 6565 | CCAGAGGGAACCAAGAGCAA | 68 | 2390 |
| 1194339 | N/A | N/A | 6547 | 6566 | CCCAGAGGGAACCAAGAGCA | 57 | 2391 |
| 1206452 | 143 | 162 | 510 | 529 | ACTGTGTGCTCTTCAGCTTT | 78 | 175 |
| 1206453 | 209 | 228 | 3560 | 3579 | TTGTGGTACAGCTGCCGGTG | 79 | 2392 |
| 1206454 | 1912 | 1931 | 7300 | 7319 | ATCACCAAGGAGGGAAAGAT | 53 | 2393 |
| 1206455 | 1920 | 1939 | 7308 | 7327 | ACTGCGGAATCACCAAGGAG | 39 | 2394 |
| 1206456 | 1925 | 1944 | 7313 | 7332 | CTCTCACTGCGGAATCACCA | 28 | 2395 |
| 1206457 | 1929 | 1948 | 7317 | 7336 | CACTCTCTCACTGCGGAATC | 17 | 2396 |
| 1206458 | 1931 | 1950 | 7319 | 7338 | GCCACTCTCTCACTGCGGAA | 25 | 2397 |
| 1206459 | 1934 | 1953 | 7322 | 7341 | CCAGCCACTCTCTCACTGCG | 42 | 2398 |
| 1206460 | N/A | N/A | 514 | 533 | ACCGACTGTGTGCTCTTCAG | 82 | 2399 |
| 1206461 | N/A | N/A | 515 | 534 | TACCGACTGTGTGCTCTTCA | 90 | 2400 |
| 1206462 | N/A | N/A | 517 | 536 | CTTACCGACTGTGTGCTCTT | 102 | 2401 |
| 1206463 | N/A | N/A | 518 | 537 | ACTTACCGACTGTGTGCTCT | 68 | 2402 |
| 1206464 | N/A | N/A | 2313 | 2332 | AGTTCAATGTTCACTGTGAT | 105 | 2403 |
| 1206465 | N/A | N/A | 2333 | 2352 | GGAACCTAATACTGTTTGCT | 92 | 2404 |
| 1206466 | N/A | N/A | 2696 | 2715 | GTTAAGGTTCAACAAGGCGT | 81 | 2405 |
| 1206467 | N/A | N/A | 2716 | 2735 | GAAAAATTTGCACATTCCCA | 92 | 2406 |
| 1206468 | N/A | N/A | 4014 | 4033 | AGCTTGGTTTACCCACCTGC | 95 | 2407 |
| 1206469 | N/A | N/A | 4034 | 4053 | CTTGCTACTCCAAGTTTCCA | 80 | 2408 |
| 1206470 | N/A | N/A | 4898 | 4917 | GGTGTCTGAGGAGAAAGGGG | 82 | 2409 |
| 1206471 | N/A | N/A | 6532 | 6551 | GAGCAAGTTCGATTCTCCCT | 67 | 2410 |
| 1206472 | N/A | N/A | 6552 | 6571 | CGGCGCCCAGAGGGAACCAA | 95 | 2411 |

TABLE 41

Reduction of FXII RNA by 5-10-5 MOE gapmers with mixed PO/PS internucleoside linkages (Huh7, electroporation, 5000 nM modified oligonucleotide)

| Compound Number | SEQ ID NO: 3 Start Site | SEQ ID NO: 3 Stop Site | SEQ ID NO: 4 Start Site | SEQ ID NO: 4 Stop Site | Sequence (5' to 3') | FXII (% UTC) | SEQ ID NO |
|---|---|---|---|---|---|---|---|
| 1131768 | N/A | N/A | 2033 | 2052 | TTTCTCAGCATTTTCAAAGC | 35 | 2412 |
| 1131767 | 10843 | 10862 | 2031 | 2050 | TCTCAGCATTTTCAAAGCAC | 25 | 2413 |
| 1131770 | N/A | N/A | 2036 | 2055 | TTTTTTCTCAGCATTTTCAA | 54 | 2414 |
| 1131771 | N/A | N/A | 2037 | 2056 | TTTTTTTCTCAGCATTTTCA | 83 | 2415 |
| 1130767 | 3458 | 3477 | 34 | 53 | TCATGGCATCCGTCCGTTGG | 36 | 617 |
| 1130768 | 3459 | 3478 | 35 | 54 | CTCATGGCATCCGTCCGTTG | 90 | 619 |
| 1132897 | 10846 | 10865 | N/A | N/A | CCTTCTCAGCATTTTCAAAG | 62 | 618 |
| 1130769 | 3460 | 3479 | 36 | 55 | CCTCATGGCATCCGTCCGTT | 22 | 540 |
| 1132898 | 10849 | 10868 | N/A | N/A | TTTCCTTCTCAGCATTTTCA | 61 | 616 |

TABLE 42

Reduction of FXII RNA by 5-10-5 MOE gapmers with mixed PO/PS internucleoside linkages (Huh7, electroporation, 5000 nM modified oligonucleotide)

| Compound Number | SEQ ID NO: 3 Start Site | SEQ ID NO: 3 Stop Site | SEQ ID NO: 4 Start Site | SEQ ID NO: 4 Stop Site | Sequence (5' to 3') | FXII (% UTC) | SEQ ID NO |
|---|---|---|---|---|---|---|---|
| 1130744 | 3428 | 3447 | 4 | 23 | TATCCAGGAGTCCAGATCAA | 61 | 2416 |
| 1130772 | 3463 | 3482 | 39 | 58 | AGCCCTCATGGCATCCGTCC | 35 | 2417 |
| 1130755 | 3443 | 3462 | 19 | 38 | GTTGGTCCAGCTGCCTATCC | 64 | 2418 |
| 1130756 | 3444 | 3463 | 20 | 39 | CGTTGGTCCAGCTGCCTATC | 50 | 2419 |
| 1130760 | 3450 | 3469 | 26 | 45 | TCCGTCCGTTGGTCCAGCTG | 37 | 2420 |
| 1130765 | 3456 | 3475 | 32 | 51 | ATGGCATCCGTCCGTTGGTC | 43 | 238 |
| 1130766 | 3457 | 3476 | 33 | 52 | CATGGCATCCGTCCGTTGGT | 50 | 314 |

Example 3: Effects of 3-10-3 cET Gapmers on Human FXII RNA In Vitro, Single Dose Modified oligonucleotides complementary to an FXII nucleic acid were synthesized and tested for their effect on FXII RNA levels in vitro. The modified oligonucleotides were tested in a series of experiments using similar culture conditions. The results for each separate experiment are presented in separate tables below.

The modified oligonucleotides in the tables below are 3-10-3 cEt gapmers (i.e., they have a central region of ten 2'-deoxynucleosides flanked on each side by wings, each comprising three cEt modified nucleosides). The internucleoside linkages throughout each modified oligonucleotide are phosphorothioate (P=S) linkages. All cytosine nucleobases throughout each modified oligonucleotide are 5-methylcytosines.

"Start site" indicates the 5'-most nucleoside of the target sequence to which the modified oligonucleotide is complementary. "Stop site" indicates the 3'-most nucleoside of the target sequence to which the modified oligonucleotide is complementary. As shown in the tables below, the modified oligonucleotides are 100% complementary to one or more of human FXII target sequences including the human FXII mRNA sequence designated herein as SEQ ID NO: 1 (ENSEMBL ID ENST00000253496.3 from ENSEMBL version 99: January 2020), the human FXII genomic sequence, designated herein as SEQ ID NO: 2 (ENSEMBL ID ENSG00000131187.9 from ENSEML version 99: January 2020), the human FXII genomic sequence, designated herein as SEQ ID No. 3 (the complement of GENBANK Accession No. NC_000005.10 truncated from truncated from nucleotides 177399001 to 177413000), and the human FXII mRNA sequence designated herein as SEQ ID No: 4 (GENBANK Accession No. NM 000505.3) 'N/A' indicates that the modified oligonucleotide is not complementary to that particular target sequence with 100% complementarity.

Cultured Huh7 cells, at a density of 20,000 cells per well, were transfected using electroporation with either 2000 nM or 3000 nM modified oligonucleotide. After a treatment period of approximately 24 hours, RNA was isolated from the cells and FXII RNA levels were measured by quantitative real-time RTPCR. Human primer probe set RTS40528 (described herein above) was used to measure RNA levels. FXII RNA levels were normalized to total RNA content, as measured by RIBOGREEN®. Reduction of FXII RNA is presented in the tables below as percent FXII RNA relative to the amount in untreated control cells (% UTC). The symbol "†" indicates that the modified oligonucleotide is complementary to the target transcript within the amplicon region of the primer probe set. In such instances, additional assays using alternative primer probes must be performed to accurately assess the potency and efficacy of such modified oligonucleotides.

TABLE 43

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128712 | 3 | 18 | 3 | 18 | AGGAGTCCAGATCAAT | 50 | 2421 |
| 1128732 | 80 | 95 | 80 | 95 | ACTCCAAGCTCACCAG | 37 | 2422 |
| 1128752 | 125 | 140 | 492 | 507 | ACTTATGCTCCTTGGG | 39 | 2423 |
| 1128772 | 156 | 171 | N/A | N/A | GTGAGAACGACTGTGT | 39 | 2424 |
| 1128792 | 200 | 215 | 3551 | 3566 | GCCGGTGGTACTGGAA | 57 | 2425 |
| 1128802 | 218 | 233 | 3569 | 3584 | TACATTTGTGGTACAG | 12 | 2426 |
| 1128813 | 231 | 246 | 3582 | 3597 | CGGCCCTTGTGGGTAC | 79 | 2427 |
| 1128833 | 294 | 309 | 3801 | 3816 | TATCCCCATCGCTGGT | 51 | 2428 |
| 1128853 | 409 | 424 | 4217 | 4232 | GAGGTGTTGTGGACAG | 45 | 2429 |
| 1128873 | 482 | 497 | 4427 | 4442 | ATATCTCATTCTTGTG | 22 | 2430 |
| 1128893 | 545 | 560 | 4490 | 4505 | GGCAGTGGGCATCAGG | 40 | 2431 |
| 1128913 | 598 | 613 | 4682 | 4697 | GCGACCCCATGGAGG | 39 | 2432 |
| 1128933 | 634 | 649 | 4718 | 4733 | GCAGTGGCACAGGCGG | 36 | 2433 |
| 1128953 | 664 | 679 | 4748 | 4763 | GTCGCAGAAGGCTCCG | 64 | 2434 |
| 1128973 | 713 | 728 | 4942 | 4957 | CGCGGTAGCTGAGCCC | 68 | 2435 |
| 1128993 | 759 | 774 | 4988 | 5003 | GCCCACGGCTGACAGG | 62 | 2436 |
| 1129013 | 807 | 822 | 5036 | 5051 | CAGTTCCGCGCTTGCT | 60 | 2437 |
| 1129033 | 863 | 878 | 5177 | 5192 | ACCACGGGCGGATGTC | 54 | 2438 |
| 1129053 | 892 | 907 | 5206 | 5221 | GCTCAGCCGGTCGCGG | 51 | 2439 |
| 1129073 | 982 | 997 | 5296 | 5311 | CATGAGTGGGACATGA | 45 | 2440 |
| 1129093 | 1043 | 1058 | 5357 | 5372 | TCTGGGACTGAGGCGG | 33 | 2441 |
| 1129113 | 1089 | 1104 | 5508 | 5523 | GTCAGGGAAGGCGGCT | 38 | 2442 |
| 1129133 | 1129 | 1144 | 5548 | 5563 | CTTGCGGAGCCGCTGC | 37 | 2443 |
| 1129153 | 1152 | 1167 | 5571 | 5586 | ACGCGGGTCATCGAAG | 53 | 2444 |
| 1129173 | 1209 | 1224 | 5628 | 5643 | CAGTACAGCGCGGCGA | 35 | 2445 |
| 1129193 | 1240 | 1255 | 5659 | 5674 | GATGAGGCTGCCGGCG | 81 | 2446 |
| 1129213 | 1319 | 1334 | 5979 | 5994 | GGCCGAGCACCACCGT | 44 | 2447 |
| 1129233 | 1384 | 1399 | 6044 | 6059 | GTGCAAGCGGTAGGAG | 76 | 2448 |
| 1129253 | 1438 | 1453 | 6181 | 6196 | CTGAAGGCGCAACAGA | 61 | 2449 |
| 1129273 | 1463 | 1478 | 6206 | 6221 | GCGCGCAGCTGCCGTC | 39 | 2450 |

TABLE 43-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129293 | 1497 | 1512 | 6240 | 6255 | GGCAGGCACACCGGCT | 93 | 2451 |
| 1129313 | 1558 | 1573 | 6301 | 6316 | CTGGTGGCCCCAGCCG | 96 | 2452 |
| 1129333 | 1580 | 1595 | 6878 | 6893 | CATATTCCTCCGCCCC | 78 | 2453 |
| 1129353 | 1619 | 1634 | 6917 | 6932 | GGGAGAGGAACGGTAC | 126 | 2454 |
| 1129373 | 1693 | 1708 | 6991 | 7006 | CTCGAGGAACCCTGCG | 27† | 2455 |
| 1129393 | 1748 | 1763 | 7136 | 7151 | GGTCCTCACACACCAG | 44† | 2456 |
| 1129413 | 1798 | 1813 | 7186 | 7201 | CGATCCCCAGCTGATG | 27 | 2457 |
| 1129433 | 1839 | 1854 | 7227 | 7242 | ACATCGGTGTAGACGC | 28 | 2458 |
| 1129453 | 1866 | 1881 | 7254 | 7269 | TCCCGGATCCAGGCCA | 41 | 2459 |
| 1129473 | 1898 | 1913 | 7286 | 7301 | ATGAGTCCCTGAGCAA | 26 | 2460 |
| 1129493 | 1931 | 1946 | 7319 | 7334 | CTCTCTCACTGCGGAA | 15 | 2461 |
| 1129513 | 1990 | 2005 | 7378 | 7393 | GCGCGGAGCTGGCCGC | 46 | 2462 |
| 1129533 | 2011 | 2026 | 7399 | 7414 | TTGAGTTCCTGCGCCA | 23 | 2463 |
| 1129553 | N/A | N/A | 97 | 112 | ACTCACCGAAAGTGTT | 78 | 2464 |
| 1129573 | N/A | N/A | 197 | 212 | CCTAGTCACCTGGACC | 63 | 2465 |
| 1129593 | N/A | N/A | 328 | 343 | CCTCCCCCCGTTGTCT | 49 | 2466 |
| 1129613 | N/A | N/A | 434 | 449 | GAACTGACTATAAGTC | 61 | 2467 |
| 1129633 | N/A | N/A | 606 | 621 | GCACTAGACTAGACTG | 54 | 2468 |
| 1129653 | N/A | N/A | 652 | 667 | CACGATCACTCTAGTG | 51 | 2469 |
| 1129673 | N/A | N/A | 908 | 923 | GAGGCATTCAGATGCC | 61 | 2470 |
| 1129693 | N/A | N/A | 1055 | 1070 | GAATACCTCACATGGG | 86 | 2471 |
| 1129713 | N/A | N/A | 1557 | 1572 | GGGTAAGGTCCATCTG | 61 | 2472 |
| 1129733 | N/A | N/A | 1709 | 1724 | CAAGGATAGGGCACCA | 50 | 2473 |
| 1129753 | N/A | N/A | 2146 | 2161 | AGGCAAAGTGCACTTG | 55 | 2474 |
| 1129773 | N/A | N/A | 2450 | 2465 | GCATTGATGAATCAGC | 47 | 2475 |
| 1129793 | N/A | N/A | 2527 | 2542 | GCACAAGAAGGCTACC | 54 | 2476 |
| 1129813 | N/A | N/A | 2852 | 2867 | AATAGTACAGTTGATC | 54 | 2477 |
| 1129833 | N/A | N/A | 3048 | 3063 | CAGGAGTCAGATAGCT | 64 | 2478 |
| 1129853 | N/A | N/A | 3652 | 3667 | GCAGGGTACATGTCTC | 68 | 2479 |
| 1129873 | N/A | N/A | 4015 | 4030 | TTGGTTTACCCACCTG | 73 | 2480 |
| 1129893 | N/A | N/A | 4316 | 4331 | ATCCAGCAACCTATTC | 67 | 2481 |
| 1129913 | N/A | N/A | 4360 | 4375 | ATAGTGGTCTCAGGAG | 64 | 2482 |
| 1129933 | N/A | N/A | 4619 | 4634 | CTGGGCCTAAAGACCC | 62 | 2483 |
| 1129953 | N/A | N/A | 5070 | 5085 | GGCGCACCGGCAGAAG | 52 | 2484 |
| 1129973 | N/A | N/A | 5418 | 5433 | CTAGCTCGCCCGGCGC | 76 | 2485 |

TABLE 43-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129993 | N/A | N/A | 5450 | 5465 | GGACGGAGAGCCCGCG | 74 | 2486 |
| 1130013 | N/A | N/A | 5755 | 5770 | GAGACGGAGGAGCCGC | 54 | 2487 |
| 1130033 | N/A | N/A | 5869 | 5884 | ACCCCAATCCCGTGTT | 61 | 2488 |
| 1130053 | N/A | N/A | 6170 | 6185 | ACAGAGCTAACCCGGG | 96 | 2489 |
| 1130073 | N/A | N/A | 6330 | 6345 | TGCCCCTAGCAGTTGT | 65 | 2490 |
| 1130093 | N/A | N/A | 6389 | 6404 | ACCAAAGTCGCGGGCT | 137 | 2491 |
| 1130113 | N/A | N/A | 6413 | 6428 | CATTCTGTAGGCACCC | 83 | 2492 |
| 1130133 | N/A | N/A | 6538 | 6553 | AAGAGCAAGTTCGATT | 51 | 2493 |
| 1130153 | N/A | N/A | 6624 | 6639 | AGTCGCAGAACCTGGC | 49 | 2494 |
| 1130173 | N/A | N/A | 6676 | 6691 | GATTTGAATGGGCGGA | 55 | 2495 |
| 1130193 | N/A | N/A | 6812 | 6827 | CGGACGATGGACAAAG | 64 | 2496 |
| 1130213 | N/A | N/A | 6876 | 6891 | TATTCCTCCGCCCCTG | 131 | 2497 |
| 1130233 | N/A | N/A | 7078 | 7093 | CGCTGTGGACCTGAGA | 89† | 2498 |

TABLE 44

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128713 | 4 | 19 | 4 | 19 | CAGGAGTCCAGATCAA | 35 | 2499 |
| 1128733 | 81 | 96 | 81 | 96 | GACTCCAAGCTCACCA | 38 | 2500 |
| 1128753 | 126 | 141 | 493 | 508 | TACTTATGCTCCTTGG | 35 | 2501 |
| 1128773 | 157 | 172 | N/A | N/A | AGTGAGAACGACTGTG | 31 | 2502 |
| 1128793 | 201 | 216 | 3552 | 3567 | TGCCGGTGGTACTGGA | 41 | 2503 |
| 1128802 | 218 | 233 | 3569 | 3584 | TACATTTGTGGTACAG | 18 | 2426 |
| 1128814 | 233 | 248 | 3584 | 3599 | GCCGGCCCTTGTGGGT | 55 | 2504 |
| 1128834 | 295 | 310 | 3802 | 3817 | GTATCCCCATCGCTGG | 35 | 2505 |
| 1128854 | 411 | 426 | 4219 | 4234 | GTGAGGTGTTGTGGAC | 38 | 2506 |
| 1128874 | 484 | 499 | 4429 | 4444 | CCATATCTCATTCTTG | 24 | 2507 |
| 1128894 | 551 | 566 | 4496 | 4511 | GCCGCTGGCAGTGGGC | 51 | 2508 |
| 1128914 | 599 | 614 | 4683 | 4698 | AGCGACCCCATGGAG | 37 | 2509 |
| 1128934 | 639 | 654 | 4723 | 4738 | ACCGGGCAGTGGCACA | 46 | 2510 |
| 1128954 | 665 | 680 | 4749 | 4764 | CGTCGCAGAAGGCTCC | 45 | 2511 |
| 1128974 | 714 | 729 | 4943 | 4958 | CCGCGGTAGCTGAGCC | 90 | 2512 |
| 1128994 | 761 | 776 | 4990 | 5005 | AGGCCCACGGCTGACA | 44 | 2513 |

TABLE 44-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129014 | 808 | 823 | 5037 | 5052 | CCAGTTCCGCGCTTGC | 33 | 2514 |
| 1129034 | 864 | 879 | 5178 | 5193 | CACCACGGGCGGATGT | 56 | 2515 |
| 1129054 | 896 | 911 | 5210 | 5225 | CCCAGCTCAGCCGGTC | 57 | 2516 |
| 1129074 | 989 | 1004 | 5303 | 5318 | GCGCGGGCATGAGTGG | 37 | 2517 |
| 1129094 | 1044 | 1059 | 5358 | 5373 | GTCTGGGACTGAGGCG | 26 | 2518 |
| 1129114 | 1090 | 1105 | 5509 | 5524 | GGTCAGGGAAGGCGGC | 21 | 2519 |
| 1129134 | 1130 | 1145 | 5549 | 5564 | TCTTGCGGAGCCGCTG | 38 | 2520 |
| 1129154 | 1153 | 1168 | 5572 | 5587 | GACGCGGGTCATCGAA | 47 | 2521 |
| 1129174 | 1210 | 1225 | 5629 | 5644 | CCAGTACAGCGCGGCG | 27 | 2522 |
| 1129194 | 1241 | 1256 | 5660 | 5675 | CGATGAGGCTGCCGGC | 53 | 2523 |
| 1129214 | 1320 | 1335 | 5980 | 5995 | TGGCCGAGCACCACCG | 38 | 2524 |
| 1129234 | 1385 | 1400 | 6045 | 6060 | CGTGCAAGCGGTAGGA | 38 | 2525 |
| 1129254 | 1439 | 1454 | 6182 | 6197 | CCTGAAGGCGCAACAG | 37 | 2526 |
| 1129274 | 1464 | 1479 | 6207 | 6222 | AGCGCGCAGCTGCCGT | 30 | 2527 |
| 1129294 | 1498 | 1513 | 6241 | 6256 | TGGCAGGCACACCGGC | 20 | 2528 |
| 1129314 | 1559 | 1574 | 6302 | 6317 | ACTGGTGGCCCCAGCC | 73 | 2529 |
| 1129334 | 1581 | 1596 | 6879 | 6894 | GCATATTCCTCCGCCC | 83 | 2530 |
| 1129354 | 1620 | 1635 | 6918 | 6933 | AGGGAGAGGAACGGTA | 69 | 2531 |
| 1129374 | 1694 | 1709 | 6992 | 7007 | CCTCGAGGAACCCTGC | 18† | 2532 |
| 1129394 | 1749 | 1764 | 7137 | 7152 | TGGTCCTCACACACCA | 41† | 2533 |
| 1129414 | 1800 | 1815 | 7188 | 7203 | CCCGATCCCCAGCTGA | 47 | 2534 |
| 1129434 | 1840 | 1855 | 7228 | 7243 | CACATCGGTGTAGACG | 34 | 2535 |
| 1129454 | 1867 | 1882 | 7255 | 7270 | CTCCCGGATCCAGGCC | 47 | 2536 |
| 1129474 | 1899 | 1914 | 7287 | 7302 | GATGAGTCCCTGAGCA | 27 | 2537 |
| 1129494 | 1946 | 1961 | 7334 | 7349 | TCCATGCCCCAGCCAC | 25 | 2538 |
| 1129514 | 1991 | 2006 | 7379 | 7394 | GGCGCGGAGCTGGCCG | 77 | 2539 |
| 1129534 | 2012 | 2027 | 7400 | 7415 | ATTGAGTTCCTGCGCC | 15 | 2540 |
| 1129554 | N/A | N/A | 99 | 114 | GCACTCACCGAAAGTG | 78 | 2541 |
| 1129574 | N/A | N/A | 198 | 213 | TCCTAGTCACCTGGAC | 53 | 2542 |
| 1129594 | N/A | N/A | 329 | 344 | ACCTCCCCCGTTGTC | 62 | 2543 |
| 1129614 | N/A | N/A | 435 | 450 | GGAACTGACTATAAGT | 53 | 2544 |
| 1129634 | N/A | N/A | 607 | 622 | GGCACTAGACTAGACT | 64 | 2545 |
| 1129654 | N/A | N/A | 653 | 668 | TCACGATCACTCTAGT | 41 | 2546 |
| 1129674 | N/A | N/A | 953 | 968 | CTCGCCCAGAGTCACC | 72 | 2547 |
| 1129694 | N/A | N/A | 1056 | 1071 | TGAATACCTCACATGG | 48 | 2548 |

TABLE 44-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129714 | N/A | N/A | 1558 | 1573 | AGGGTAAGGTCCATCT | 35 | 2549 |
| 1129734 | N/A | N/A | 1710 | 1725 | GCAAGGATAGGGCACC | 57 | 2550 |
| 1129754 | N/A | N/A | 2250 | 2265 | TTCAGAGGAATTGTCG | 52 | 2551 |
| 1129774 | N/A | N/A | 2452 | 2467 | TAGCATTGATGAATCA | 72 | 2552 |
| 1129794 | N/A | N/A | 2540 | 2555 | GTGTAGTTCCTAAGCA | 57 | 2553 |
| 1129814 | N/A | N/A | 2862 | 2877 | CGGCAGTAATAATAGT | 77 | 2554 |
| 1129834 | N/A | N/A | 3373 | 3388 | TCTAAAAGTTGGGTTC | 51 | 2555 |
| 1129854 | N/A | N/A | 3704 | 3719 | GCCCTATCACAGTCCC | 53 | 2556 |
| 1129874 | N/A | N/A | 4017 | 4032 | GCTTGGTTTACCCACC | 70 | 2557 |
| 1129894 | N/A | N/A | 4318 | 4333 | GTATCCAGCAACCTAT | 48 | 2558 |
| 1129914 | N/A | N/A | 4361 | 4376 | GATAGTGGTCTCAGGA | 58 | 2559 |
| 1129934 | N/A | N/A | 4620 | 4635 | CCTGGGCCTAAAGACC | 85 | 2560 |
| 1129954 | N/A | N/A | 5071 | 5086 | CGGCGCACCGGCAGAA | 42 | 2561 |
| 1129974 | N/A | N/A | 5419 | 5434 | TCTAGCTCGCCCGGCG | 61 | 2562 |
| 1129994 | N/A | N/A | 5451 | 5466 | AGGACGGAGAGCCCGC | 49 | 2563 |
| 1130014 | N/A | N/A | 5762 | 5777 | GCGCTGGGAGACGGAG | 101 | 2564 |
| 1130034 | N/A | N/A | 5870 | 5885 | AACCCCAATCCCGTGT | 54 | 2565 |
| 1130054 | N/A | N/A | 6171 | 6186 | AACAGAGCTAACCCGG | 62 | 2566 |
| 1130074 | N/A | N/A | 6331 | 6346 | CTGCCCCTAGCAGTTG | 118 | 2567 |
| 1130094 | N/A | N/A | 6390 | 6405 | TACCAAAGTCGCGGGC | 46 | 2568 |
| 1130114 | N/A | N/A | 6420 | 6435 | CGCCACCCATTCTGTA | 54 | 2569 |
| 1130134 | N/A | N/A | 6539 | 6554 | CAAGAGCAAGTTCGAT | 69 | 2570 |
| 1130154 | N/A | N/A | 6626 | 6641 | AGAGTCGCAGAACCTG | 51 | 2571 |
| 1130174 | N/A | N/A | 6677 | 6692 | GGATTTGAATGGGCGG | 48 | 2572 |
| 1130194 | N/A | N/A | 6813 | 6828 | CCGGACGATGGACAAA | 56 | 2573 |
| 1130214 | N/A | N/A | 6877 | 6892 | ATATTCCTCCGCCCCT | 78 | 2574 |
| 1130234 | N/A | N/A | 7091 | 7106 | ACACGCAGCTCAGCGC | 56† | 2575 |

TABLE 45

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128714 | 6 | 21 | 6 | 21 | TCCAGGAGTCCAGATC | 85 | 2576 |
| 1128734 | 82 | 97 | 82 | 97 | TGACTCCAAGCTCACC | 30 | 2577 |

TABLE 45-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128754 | 127 | 142 | 494 | 509 | GTACTTATGCTCCTTG | 16 | 2578 |
| 1128774 | 158 | 173 | N/A | N/A | CAGTGAGAACGACTGT | 36 | 2579 |
| 1128794 | 202 | 217 | 3553 | 3568 | CTGCCGGTGGTACTGG | 22 | 2580 |
| 1128802 | 218 | 233 | 3569 | 3584 | TACATTTGTGGTACAG | 12 | 2426 |
| 1128815 | 235 | 250 | 3586 | 3601 | TGGCCGGCCCTTGTGG | 57 | 2581 |
| 1128835 | 297 | 312 | 3804 | 3819 | CAGTATCCCCATCGCT | 16 | 2582 |
| 1128855 | 412 | 427 | 4220 | 4235 | AGTGAGGTGTTGTGGA | 38 | 2583 |
| 1128875 | 487 | 502 | 4432 | 4447 | ATACCATATCTCATTC | 18 | 2584 |
| 1128895 | 552 | 567 | 4497 | 4512 | AGCCGCTGGCAGTGGG | 49 | 2585 |
| 1128915 | 600 | 615 | 4684 | 4699 | CAGCGACCCCCATGGA | 30 | 2586 |
| 1128935 | 640 | 655 | 4724 | 4739 | CACCGGGCAGTGGCAC | 32 | 2587 |
| 1128955 | 679 | 694 | N/A | N/A | TGCCTTGGTGTCCACG | 31 | 2588 |
| 1128975 | 715 | 730 | 4944 | 4959 | GCCGCGGTAGCTGAGC | 52 | 2589 |
| 1128995 | 762 | 777 | 4991 | 5006 | GAGGCCCACGGCTGAC | 31 | 2590 |
| 1129015 | 809 | 824 | 5038 | 5053 | CCCAGTTCCGCGCTTG | 18 | 2591 |
| 1129035 | 866 | 881 | 5180 | 5195 | AGCACCACGGGCGGAT | 26 | 2592 |
| 1129055 | 897 | 912 | 5211 | 5226 | TCCCAGCTCAGCCGGT | 27 | 2593 |
| 1129075 | 990 | 1005 | 5304 | 5319 | TGCGCGGGCATGAGTG | 24 | 2594 |
| 1129095 | 1060 | 1075 | N/A | N/A | CGGCAAGGCTCCCGGG | 35 | 2595 |
| 1129115 | 1099 | 1114 | 5518 | 5533 | GCCGTTCCTGGTCAGG | 25 | 2596 |
| 1129135 | 1131 | 1146 | 5550 | 5565 | CTCTTGCGGAGCCGCT | 22 | 2597 |
| 1129155 | 1154 | 1169 | 5573 | 5588 | CGACGCGGGTCATCGA | 58 | 2598 |
| 1129175 | 1211 | 1226 | 5630 | 5645 | CCCAGTACAGCGCGGC | 22 | 2599 |
| 1129195 | 1242 | 1257 | 5661 | 5676 | GCGATGAGGCTGCCGG | 30 | 2600 |
| 1129215 | 1321 | 1336 | 5981 | 5996 | CTGGCCGAGCACCACC | 23 | 2601 |
| 1129235 | 1399 | 1414 | 6059 | 6074 | GGGCGAGAAGGCCTCG | 60 | 2602 |
| 1129255 | 1440 | 1455 | 6183 | 6198 | TCCTGAAGGCGCAACA | 22 | 2603 |
| 1129275 | 1465 | 1480 | 6208 | 6223 | GAGCGCGCAGCTGCCG | 18 | 2604 |
| 1129295 | 1499 | 1514 | 6242 | 6257 | TTGGCAGGCACACCGG | 20 | 2605 |
| 1129315 | 1560 | 1575 | 6303 | 6318 | AACTGGTGGCCCCAGC | 38 | 2606 |
| 1129335 | 1582 | 1597 | 6880 | 6895 | GGCATATTCCTCCGCC | 42 | 2607 |
| 1129355 | 1621 | 1636 | 6919 | 6934 | CAGGGAGAGGAACGGT | 43 | 2608 |
| 1129375 | 1695 | 1710 | 6993 | 7008 | CCCTCGAGGAACCCTG | 9† | 2609 |
| 1129395 | 1750 | 1765 | 7138 | 7153 | TTGGTCCTCACACACC | 24† | 2610 |
| 1129415 | 1801 | 1816 | 7189 | 7204 | GCCCGATCCCCAGCTG | 33 | 2611 |

TABLE 45-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129435 | 1841 | 1856 | 7229 | 7244 | CCACATCGGTGTAGAC | 20 | 2612 |
| 1129455 | 1868 | 1883 | 7256 | 7271 | GCTCCCGGATCCAGGC | 34 | 2613 |
| 1129475 | 1900 | 1915 | 7288 | 7303 | AGATGAGTCCCTGAGC | 10 | 2614 |
| 1129495 | 1947 | 1962 | 7335 | 7350 | TTCCATGCCCCAGCCA | 20 | 2615 |
| 1129515 | 1992 | 2007 | 7380 | 7395 | TGGCGCGGAGCTGGCC | 49 | 2616 |
| 1129535 | 2013 | 2028 | 7401 | 7416 | TATTGAGTTCCTGCGC | 8 | 2617 |
| 1129555 | N/A | N/A | 100 | 115 | AGCACTCACCGAAAGT | 105 | 2618 |
| 1129575 | N/A | N/A | 199 | 214 | CTCCTAGTCACCTGGA | 80 | 2619 |
| 1129595 | N/A | N/A | 332 | 347 | TCTACCTCCCCCCGTT | 117 | 2620 |
| 1129615 | N/A | N/A | 436 | 451 | GGGAACTGACTATAAG | 153 | 2621 |
| 1129635 | N/A | N/A | 608 | 623 | AGGCACTAGACTAGAC | 62 | 2622 |
| 1129655 | N/A | N/A | 654 | 669 | CTCACGATCACTCTAG | 56 | 2623 |
| 1129675 | N/A | N/A | 955 | 970 | CCCTCGCCCAGAGTCA | 58 | 2624 |
| 1129695 | N/A | N/A | 1059 | 1074 | GGCTGAATACCTCACA | 36 | 2625 |
| 1129715 | N/A | N/A | 1559 | 1574 | CAGGGTAAGGTCCATC | 33 | 2626 |
| 1129735 | N/A | N/A | 1711 | 1726 | GGCAAGGATAGGGCAC | 50 | 2627 |
| 1129755 | N/A | N/A | 2279 | 2294 | CGCGAATAATGAGAAT | 64 | 2628 |
| 1129775 | N/A | N/A | 2457 | 2472 | CAGCTTAGCATTGATG | 52 | 2629 |
| 1129795 | N/A | N/A | 2543 | 2558 | GCTGTGTAGTTCCTAA | 56 | 2630 |
| 1129815 | N/A | N/A | 2863 | 2878 | ACGGCAGTAATAATAG | 49 | 2631 |
| 1129835 | N/A | N/A | 3375 | 3390 | GCTCTAAAAGTTGGGT | 60 | 2632 |
| 1129855 | N/A | N/A | 3764 | 3779 | TAGCACACCTGTAGAA | 83 | 2633 |
| 1129875 | N/A | N/A | 4018 | 4033 | AGCTTGGTTTACCCAC | 42 | 2634 |
| 1129895 | N/A | N/A | 4320 | 4335 | GAGTATCCAGCAACCT | 49 | 2635 |
| 1129915 | N/A | N/A | 4362 | 4377 | GGATAGTGGTCTCAGG | 65 | 2636 |
| 1129935 | N/A | N/A | 4622 | 4637 | CCCCTGGGCCTAAAGA | 72 | 2637 |
| 1129955 | N/A | N/A | 5072 | 5087 | GCGGCGCACCGGCAGA | 55 | 2638 |
| 1129975 | N/A | N/A | 5420 | 5435 | ATCTAGCTCGCCCGGC | 37 | 2639 |
| 1129995 | N/A | N/A | 5452 | 5467 | GAGGACGGAGAGCCCG | 88 | 2640 |
| 1130015 | N/A | N/A | 5763 | 5778 | TGCGCTGGGAGACGGA | 73 | 2641 |
| 1130035 | N/A | N/A | 5871 | 5886 | GAACCCCAATCCCGTG | 49 | 2642 |
| 1130055 | N/A | N/A | 6172 | 6187 | CAACAGAGCTAACCCG | 59 | 2643 |
| 1130075 | N/A | N/A | 6355 | 6370 | GATCAAAGGTCTCCTC | 41 | 2644 |
| 1130095 | N/A | N/A | 6391 | 6406 | ATACCAAAGTCGCGGG | 80 | 2645 |
| 1130115 | N/A | N/A | 6434 | 6449 | ACCCATCAGGTCAGCG | 59 | 2646 |
| 1130135 | N/A | N/A | 6540 | 6555 | CCAAGAGCAAGTTCGA | 47 | 2647 |

TABLE 45-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130155 | N/A | N/A | 6627 | 6642 | CAGAGTCGCAGAACCT | 48 | 2648 |
| 1130175 | N/A | N/A | 6678 | 6693 | AGGATTTGAATGGGCG | 38 | 2649 |
| 1130195 | N/A | N/A | 6814 | 6829 | CCCGGACGATGGACAA | 68 | 2650 |
| 1130215 | N/A | N/A | 7015 | 7030 | CACCTGGCACGCATCG | 24† | 2651 |
| 1130235 | N/A | N/A | 7093 | 7108 | AAACACGCAGCTCAGC | 81† | 2652 |

TABLE 46

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128715 | 9 | 24 | 9 | 24 | CTATCCAGGAGTCCAG | 70 | 2653 |
| 1128735 | 87 | 102 | 87 | 102 | AGTGTTGACTCCAAGC | 22 | 2654 |
| 1128755 | 128 | 143 | 495 | 510 | TGTACTTATGCTCCTT | 23 | 2655 |
| 1128775 | 159 | 174 | N/A | N/A | ACAGTGAGAACGACTG | 48 | 2656 |
| 1128795 | 210 | 225 | 3561 | 3576 | TGGTACAGCTGCCGGT | 17 | 2657 |
| 1128802 | 218 | 233 | 3569 | 3584 | TACATTTGTGGTACAG | 8 | 2426 |
| 1128816 | 236 | 251 | 3587 | 3602 | CTGGCCGGCCCTTGTG | 35 | 2658 |
| 1128836 | 298 | 313 | 3805 | 3820 | ACAGTATCCCCATCGC | 16 | 2659 |
| 1128856 | 413 | 428 | 4221 | 4236 | CAGTGAGGTGTTGTGG | 34 | 2660 |
| 1128876 | 489 | 504 | 4434 | 4449 | CTATACCATATCTCAT | 20 | 2661 |
| 1128896 | 556 | 571 | 4501 | 4516 | GGCCAGCCGCTGGCAG | 74 | 2662 |
| 1128916 | 601 | 616 | 4685 | 4700 | GCAGCGACCCCCATGG | 19 | 2663 |
| 1128936 | 641 | 656 | 4725 | 4740 | CCACCGGGCAGTGGCA | 28 | 2664 |
| 1128956 | 683 | 698 | 4912 | 4927 | AGCTTGCCTTGGTGTC | 22 | 2665 |
| 1128976 | 716 | 731 | 4945 | 4960 | GGCCGCGGTAGCTGAG | 62 | 2666 |
| 1128996 | 765 | 780 | 4994 | 5009 | TCCGAGGCCCACGGCT | 30 | 2667 |
| 1129016 | 810 | 825 | 5039 | 5054 | CCCCAGTTCCGCGCTT | 36 | 2668 |
| 1129036 | 867 | 882 | 5181 | 5196 | AAGCACCACGGGCGGA | 25 | 2669 |
| 1129056 | 905 | 920 | 5219 | 5234 | CGCAGTACTCCCAGCT | 20 | 2670 |
| 1129076 | 991 | 1006 | 5305 | 5320 | CTGCGCGGGCATGAGT | 23 | 2671 |
| 1129096 | 1061 | 1076 | N/A | N/A | CCGGCAAGGCTCCCGG | 66 | 2672 |
| 1129116 | 1102 | 1117 | 5521 | 5536 | TGGGCCGTTCCTGGTC | 31 | 2673 |
| 1129136 | 1132 | 1147 | 5551 | 5566 | ACTCTTGCGGAGCCGC | 16 | 2674 |

TABLE 46-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129156 | 1156 | 1171 | 5575 | 5590 | AACGACGCGGGTCATC | 54 | 2675 |
| 1129176 | 1212 | 1227 | 5631 | 5646 | CCCCAGTACAGCGCGG | 41 | 2676 |
| 1129196 | 1243 | 1258 | 5662 | 5677 | GGCGATGAGGCTGCCG | 79 | 2677 |
| 1129216 | 1323 | 1338 | 5983 | 5998 | TCCTGGCCGAGCACCA | 32 | 2678 |
| 1129236 | 1400 | 1415 | 6060 | 6075 | CGGGCGAGAAGGCCTC | 46 | 2679 |
| 1129256 | 1441 | 1456 | 6184 | 6199 | CTCCTGAAGGCGCAAC | 34 | 2680 |
| 1129276 | 1467 | 1482 | 6210 | 6225 | AGGAGCGCGCAGCTGC | 18 | 2681 |
| 1129296 | 1502 | 1517 | 6245 | 6260 | CGCTTGGCAGGCACAC | 29 | 2682 |
| 1129316 | 1561 | 1576 | 6304 | 6319 | GAACTGGTGGCCCCAG | 32 | 2683 |
| 1129336 | 1583 | 1598 | 6881 | 6896 | TGGCATATTCCTCCGC | 37 | 2684 |
| 1129356 | 1657 | 1672 | 6955 | 6970 | GGAGGATCCGTGCACG | 3† | 2685 |
| 1129376 | 1696 | 1711 | 6994 | 7009 | GCCCTCGAGGAACCCT | 11† | 2686 |
| 1129396 | 1751 | 1766 | 7139 | 7154 | CTTGGTCCTCACACAC | 9† | 2687 |
| 1129416 | 1802 | 1817 | 7190 | 7205 | AGCCCGATCCCCAGCT | 36 | 2688 |
| 1129436 | 1842 | 1857 | 7230 | 7245 | GCCACATCGGTGTAGA | 23 | 2689 |
| 1129456 | 1876 | 1891 | 7264 | 7279 | AACGGTGTGCTCCCGG | 17 | 2690 |
| 1129476 | 1901 | 1916 | 7289 | 7304 | AAGATGAGTCCCTGAG | 7 | 2691 |
| 1129496 | 1948 | 1963 | 7336 | 7351 | CTTCCATGCCCCAGCC | 16 | 2692 |
| 1129516 | 1993 | 2008 | 7381 | 7396 | CTGGCGCGGAGCTGGC | 12 | 2693 |
| 1129536 | 2014 | 2029 | 7402 | 7417 | TTATTGAGTTCCTGCG | 10 | 2694 |
| 1129556 | N/A | N/A | 101 | 116 | CAGCACTCACCGAAAG | 55 | 2695 |
| 1129576 | N/A | N/A | 204 | 219 | TAGGCCTCCTAGTCAC | 57 | 2696 |
| 1129596 | N/A | N/A | 333 | 348 | TTCTACCTCCCCCCGT | 92 | 2697 |
| 1129616 | N/A | N/A | 439 | 454 | GCAGGGAACTGACTAT | 143 | 2698 |
| 1129636 | N/A | N/A | 610 | 625 | GTAGGCACTAGACTAG | 52 | 2699 |
| 1129656 | N/A | N/A | 655 | 670 | GCTCACGATCACTCTA | 33 | 2700 |
| 1129676 | N/A | N/A | 957 | 972 | ATCCCTCGCCCAGAGT | 66 | 2701 |
| 1129696 | N/A | N/A | 1061 | 1076 | TGGGCTGAATACCTCA | 52 | 2702 |
| 1129716 | N/A | N/A | 1560 | 1575 | CCAGGGTAAGGTCCAT | 45 | 2703 |
| 1129736 | N/A | N/A | 1713 | 1728 | TAGGCAAGGATAGGGC | 66 | 2704 |
| 1129756 | N/A | N/A | 2280 | 2295 | TCGCGAATAATGAGAA | 38 | 2705 |
| 1129776 | N/A | N/A | 2459 | 2474 | ATCAGCTTAGCATTGA | 55 | 2706 |
| 1129796 | N/A | N/A | 2628 | 2643 | TCTACTTAGTGCAACG | 30 | 2707 |
| 1129816 | N/A | N/A | 2910 | 2925 | TCACTGTTAACCACTC | 52 | 2708 |
| 1129836 | N/A | N/A | 3376 | 3391 | TGCTCTAAAAGTTGGG | 63 | 2709 |
| 1129856 | N/A | N/A | 3770 | 3785 | GGGTGGTAGCACACCT | 55 | 2710 |

TABLE 46-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129876 | N/A | N/A | 4019 | 4034 | AAGCTTGGTTTACCCA | 49 | 2711 |
| 1129896 | N/A | N/A | 4321 | 4336 | CGAGTATCCAGCAACC | 83 | 2712 |
| 1129916 | N/A | N/A | 4363 | 4378 | GGGATAGTGGTCTCAG | 32 | 2713 |
| 1129936 | N/A | N/A | 4624 | 4639 | CACCCCTGGGCCTAAA | 75 | 2714 |
| 1129956 | N/A | N/A | 5073 | 5088 | CGCGGCGCACCGGCAG | 55 | 2715 |
| 1129976 | N/A | N/A | 5421 | 5436 | AATCTAGCTCGCCCGG | 39 | 2716 |
| 1129996 | N/A | N/A | 5453 | 5468 | TGAGGACGGAGAGCCC | 53 | 2717 |
| 1130016 | N/A | N/A | 5764 | 5779 | CTGCGCTGGGAGACGG | 64 | 2718 |
| 1130036 | N/A | N/A | 5872 | 5887 | CGAACCCCAATCCCGT | 57 | 2719 |
| 1130056 | N/A | N/A | 6174 | 6189 | CGCAACAGAGCTAACC | 43 | 2720 |
| 1130076 | N/A | N/A | 6360 | 6375 | CCAGTGATCAAAGGTC | 71 | 2721 |
| 1130096 | N/A | N/A | 6392 | 6407 | GATACCAAAGTCGCGG | 44 | 2722 |
| 1130116 | N/A | N/A | 6437 | 6452 | ACAACCCATCAGGTCA | 54 | 2723 |
| 1130136 | N/A | N/A | 6541 | 6556 | ACCAAGAGCAAGTTCG | 51 | 2724 |
| 1130156 | N/A | N/A | 6628 | 6643 | CCAGAGTCGCAGAACC | 47 | 2725 |
| 1130176 | N/A | N/A | 6752 | 6767 | CAGCAAGCCCGAAGGG | 60 | 2726 |
| 1130196 | N/A | N/A | 6815 | 6830 | GCCCGGACGATGGACA | 47 | 2727 |
| 1130216 | N/A | N/A | 7016 | 7031 | TCACCTGGCACGCATC | 32† | 2728 |
| 1130236 | N/A | N/A | 7094 | 7109 | GAAACACGCAGCTCAG | 74† | 2729 |

TABLE 47

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128716 | 11 | 26 | 11 | 26 | GCCTATCCAGGAGTCC | 73 | 2730 |
| 1128736 | 89 | 104 | 89 | 104 | AAAGTGTTGACTCCAA | 21 | 2731 |
| 1128756 | 129 | 144 | 496 | 511 | TTGTACTTATGCTCCT | 34 | 2732 |
| 1128776 | 160 | 175 | N/A | N/A | GACAGTGAGAACGACT | 14 | 2733 |
| 1128796 | 212 | 227 | 3563 | 3578 | TGTGGTACAGCTGCCG | 11 | 2734 |
| 1128802 | 218 | 233 | 3569 | 3584 | TACATTTGTGGTACAG | 7 | 2426 |
| 1128817 | 238 | 253 | 3589 | 3604 | GCCTGGCCGGCCCTTG | 46 | 2735 |
| 1128837 | 299 | 314 | 3806 | 3821 | AACAGTATCCCCATCG | 30 | 2736 |
| 1128857 | 414 | 429 | 4222 | 4237 | CCAGTGAGGTGTTGTG | 29 | 2737 |

TABLE 47-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128877 | 492 | 507 | 4437 | 4452 | GTTCTATACCATATCT | 24 | 2738 |
| 1128897 | 572 | 587 | N/A | N/A | TGCGGCAGGCCTGGCT | 72 | 2739 |
| 1128917 | 602 | 617 | 4686 | 4701 | GGCAGCGACCCCCATG | 24 | 2740 |
| 1128937 | 642 | 657 | 4726 | 4741 | CCCACCGGGCAGTGGC | 50 | 2741 |
| 1128957 | 686 | 701 | 4915 | 4930 | AGCAGCTTGCCTTGGT | 19 | 2742 |
| 1128977 | 718 | 733 | 4947 | 4962 | CAGGCCGCGGTAGCTG | 70 | 2743 |
| 1128997 | 766 | 781 | 4995 | 5010 | CTCCGAGGCCCACGGC | 43 | 2744 |
| 1129017 | 811 | 826 | 5040 | 5055 | TCCCCAGTTCCGCGCT | 47 | 2745 |
| 1129037 | 869 | 884 | 5183 | 5198 | CGAAGCACCACGGGCG | 14 | 2746 |
| 1129057 | 906 | 921 | 5220 | 5235 | TCGCAGTACTCCCAGC | 15 | 2747 |
| 1129077 | 993 | 1008 | 5307 | 5322 | GGCTGCGCGGGCATGA | 26 | 2748 |
| 1129097 | 1062 | 1077 | N/A | N/A | GCCGGCAAGGCTCCCG | 34 | 2749 |
| 1129117 | 1104 | 1119 | 5523 | 5538 | AGTGGGCCGTTCCTGG | 23 | 2750 |
| 1129137 | 1133 | 1148 | 5552 | 5567 | GACTCTTGCGGAGCCG | 16 | 2751 |
| 1129157 | 1157 | 1172 | 5576 | 5591 | CAACGACGCGGGTCAT | 39 | 2752 |
| 1129177 | 1215 | 1230 | 5634 | 5649 | TGGCCCCAGTACAGCG | 60 | 2753 |
| 1129197 | 1244 | 1259 | 5663 | 5678 | GGGCGATGAGGCTGCC | 67 | 2754 |
| 1129217 | 1349 | 1364 | 6009 | 6024 | ACGGCTCACAGCTGTG | 67 | 2755 |
| 1129237 | 1401 | 1416 | 6061 | 6076 | ACGGGCGAGAAGGCCT | 51 | 2756 |
| 1129257 | 1442 | 1457 | 6185 | 6200 | CCTCCTGAAGGCGCAA | 33 | 2757 |
| 1129277 | 1468 | 1483 | 6211 | 6226 | CAGGAGCGCGCAGCTG | 29 | 2758 |
| 1129297 | 1503 | 1518 | 6246 | 6261 | CCGCTTGGCAGGCACA | 26 | 2759 |
| 1129317 | 1562 | 1577 | 6305 | 6320 | CGAACTGGTGGCCCCA | 35 | 2760 |
| 1129337 | 1584 | 1599 | 6882 | 6897 | CTGGCATATTCCTCCG | 47 | 2761 |
| 1129357 | 1658 | 1673 | 6956 | 6971 | TGGAGGATCCGTGCAC | 4† | 2762 |
| 1129377 | 1697 | 1712 | 6995 | 7010 | CGCCCTCGAGGAACCC | 13† | 2763 |
| 1129397 | 1752 | 1767 | 7140 | 7155 | GCTTGGTCCTCACACA | 6† | 2764 |
| 1129417 | 1803 | 1818 | 7191 | 7206 | CAGCCCGATCCCCAGC | 24 | 2765 |
| 1129437 | 1843 | 1858 | 7231 | 7246 | GGCCACATCGGTGTAG | 45 | 2766 |
| 1129457 | 1877 | 1892 | 7265 | 7280 | AAACGGTGTGCTCCCG | 15 | 2767 |
| 1129477 | 1902 | 1917 | 7290 | 7305 | AAAGATGAGTCCCTGA | 9 | 2768 |
| 1129497 | 1949 | 1964 | 7337 | 7352 | CCTTCCATGCCCCAGC | 4 | 2769 |
| 1129517 | 1994 | 2009 | 7382 | 7397 | CCTGGCGCGGAGCTGG | 20 | 2770 |
| 1129537 | 2016 | 2031 | 7404 | 7419 | CTTTATTGAGTTCCTG | 4 | 2771 |
| 1129557 | N/A | N/A | 119 | 134 | GGACAATCCTGGTTCC | 55 | 2772 |
| 1129577 | N/A | N/A | 206 | 221 | CATAGGCCTCCTAGTC | 88 | 2773 |

TABLE 47-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129597 | N/A | N/A | 334 | 349 | TTTCTACCTCCCCCCG | 77 | 2774 |
| 1129617 | N/A | N/A | 463 | 478 | GGAATCTACAAGGGAG | 76 | 2775 |
| 1129637 | N/A | N/A | 612 | 627 | AGGTAGGCACTAGACT | 67 | 2776 |
| 1129657 | N/A | N/A | 659 | 674 | CACAGCTCACGATCAC | 58 | 2777 |
| 1129677 | N/A | N/A | 958 | 973 | AATCCCTCGCCCAGAG | 71 | 2778 |
| 1129697 | N/A | N/A | 1125 | 1140 | TCATCTAAAAGGTAGT | 47 | 2779 |
| 1129717 | N/A | N/A | 1561 | 1576 | ACCAGGGTAAGGTCCA | 56 | 2780 |
| 1129737 | N/A | N/A | 1716 | 1731 | GATTAGGCAAGGATAG | 66 | 2781 |
| 1129757 | N/A | N/A | 2281 | 2296 | ATCGCGAATAATGAGA | 58 | 2782 |
| 1129777 | N/A | N/A | 2468 | 2483 | TATAGTGCCATCAGCT | 60 | 2783 |
| 1129797 | N/A | N/A | 2629 | 2644 | GTCTACTTAGTGCAAC | 64 | 2784 |
| 1129817 | N/A | N/A | 2912 | 2927 | AGTCACTGTTAACCAC | 51 | 2785 |
| 1129837 | N/A | N/A | 3401 | 3416 | GTCGCTGTGCATTGAA | 42 | 2786 |
| 1129857 | N/A | N/A | 3881 | 3896 | GTAATGAGGCGGGAGG | 62 | 2787 |
| 1129877 | N/A | N/A | 4035 | 4050 | GCTACTCCAAGTTTCC | 40 | 2788 |
| 1129897 | N/A | N/A | 4322 | 4337 | CCGAGTATCCAGCAAC | 53 | 2789 |
| 1129917 | N/A | N/A | 4365 | 4380 | GAGGGATAGTGGTCTC | 95 | 2790 |
| 1129937 | N/A | N/A | 4634 | 4649 | CGCAGTGAGCCACCCC | 71 | 2791 |
| 1129957 | N/A | N/A | 5074 | 5089 | ACGCGGCGCACCGGCA | 55 | 2792 |
| 1129977 | N/A | N/A | 5422 | 5437 | GAATCTAGCTCGCCCG | 78 | 2793 |
| 1129997 | N/A | N/A | 5482 | 5497 | CGCCGGCAAGGCTGTG | 77 | 2794 |
| 1130017 | N/A | N/A | 5766 | 5781 | AGCTGCGCTGGGAGAC | 79 | 2795 |
| 1130037 | N/A | N/A | 5873 | 5888 | CCGAACCCCAATCCCG | 97 | 2796 |
| 1130057 | N/A | N/A | 6175 | 6190 | GCGCAACAGAGCTAAC | 57 | 2797 |
| 1130077 | N/A | N/A | 6367 | 6382 | GCCTAACCCAGTGATC | 95 | 2798 |
| 1130097 | N/A | N/A | 6393 | 6408 | CGATACCAAAGTCGCG | 97 | 2799 |
| 1130117 | N/A | N/A | 6438 | 6453 | CACAACCCATCAGGTC | 57 | 2800 |
| 1130137 | N/A | N/A | 6567 | 6582 | CCTTTGCAGCCCGGCG | 69 | 2801 |
| 1130157 | N/A | N/A | 6629 | 6644 | TCCAGAGTCGCAGAAC | 61 | 2802 |
| 1130177 | N/A | N/A | 6753 | 6768 | GCAGCAAGCCCGAAGG | 65 | 2803 |
| 1130197 | N/A | N/A | 6816 | 6831 | CGCCCGGACGATGGAC | 59 | 2804 |
| 1130217 | N/A | N/A | 7017 | 7032 | CTCACCTGGCACGCAT | 64† | 2805 |
| 1130237 | N/A | N/A | 7095 | 7110 | GGAAACACGCAGCTCA | 73† | 2806 |

TABLE 48

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128717 | 12 | 27 | 12 | 27 | TGCCTATCCAGGAGTC | 97 | 2807 |
| 1128737 | 90 | 105 | 90 | 105 | GAAAGTGTTGACTCCA | 24 | 2808 |
| 1128757 | 131 | 146 | 498 | 513 | CTTTGTACTTATGCTC | 46 | 2809 |
| 1128777 | 161 | 176 | N/A | N/A | TGACAGTGAGAACGAC | 31 | 2810 |
| 1128797 | 213 | 228 | 3564 | 3579 | TTGTGGTACAGCTGCC | 15 | 2811 |
| 1128802 | 218 | 233 | 3569 | 3584 | TACATTTGTGGTACAG | 18 | 2426 |
| 1128818 | 243 | 258 | 3594 | 3609 | TGAGGGCCTGGCCGGC | 68 | 2812 |
| 1128838 | 300 | 315 | 3807 | 3822 | AAACAGTATCCCCATC | 57 | 2813 |
| 1128858 | 415 | 430 | 4223 | 4238 | TCCAGTGAGGTGTTGT | 35 | 2814 |
| 1128878 | 493 | 508 | 4438 | 4453 | AGTTCTATACCATATC | 15 | 2815 |
| 1128898 | 581 | 596 | 4665 | 4680 | ACGGGTTGGTGCGGCA | 44 | 2816 |
| 1128918 | 603 | 618 | 4687 | 4702 | AGGCAGCGACCCCCAT | 33 | 2817 |
| 1128938 | 643 | 658 | 4727 | 4742 | GCCCACCGGGCAGTGG | 83 | 2818 |
| 1128958 | 689 | 704 | 4918 | 4933 | CATAGCAGCTTGCCTT | 17 | 2819 |
| 1128978 | 720 | 735 | 4949 | 4964 | GCCAGGCCGCGGTAGC | 63 | 2820 |
| 1128998 | 767 | 782 | 4996 | 5011 | CCTCCGAGGCCCACGG | 35 | 2821 |
| 1129018 | 812 | 827 | 5041 | 5056 | GTCCCCAGTTCCGCGC | 66 | 2822 |
| 1129038 | 870 | 885 | 5184 | 5199 | ACGAAGCACCACGGGC | 30 | 2823 |
| 1129058 | 907 | 922 | 5221 | 5236 | GTCGCAGTACTCCCAG | 19 | 2824 |
| 1129078 | 995 | 1010 | 5309 | 5324 | CCGGCTGCGCGGGCAT | 33 | 2825 |
| 1129098 | 1063 | 1078 | N/A | N/A | CGCCGGCAAGGCTCCC | 42 | 2826 |
| 1129118 | 1106 | 1121 | 5525 | 5540 | TCAGTGGGCCGTTCCT | 30 | 2827 |
| 1129138 | 1134 | 1149 | 5553 | 5568 | AGACTCTTGCGGAGCC | 21 | 2828 |
| 1129158 | 1158 | 1173 | 5577 | 5592 | CCAACGACGCGGGTCA | 29 | 2829 |
| 1129178 | 1220 | 1235 | 5639 | 5654 | AACTGTGGCCCCAGTA | 42 | 2830 |
| 1129198 | 1261 | 1276 | 5680 | 5695 | CGTCAGCACCCAGCAG | 54 | 2831 |
| 1129218 | 1352 | 1367 | 6012 | 6027 | GGCACGGCTCACAGCT | 34 | 2832 |
| 1129238 | 1402 | 1417 | 6062 | 6077 | GACGGGCGAGAAGGCC | 42 | 2833 |
| 1129258 | 1443 | 1458 | 6186 | 6201 | TCCTCCTGAAGGCGCA | 38 | 2834 |
| 1129278 | 1469 | 1484 | 6212 | 6227 | ACAGGAGCGCGCAGCT | 37 | 2835 |
| 1129298 | 1504 | 1519 | 6247 | 6262 | GCCGCTTGGCAGGCAC | 77 | 2836 |
| 1129318 | 1563 | 1578 | 6306 | 6321 | TCGAACTGGTGGCCCC | 76 | 2837 |
| 1129338 | 1591 | 1606 | 6889 | 6904 | CAGGAAGCTGGCATAT | 59 | 2838 |
| 1129358 | 1659 | 1674 | 6957 | 6972 | ATGGAGGATCCGTGCA | 10[†] | 2839 |
| 1129378 | 1698 | 1713 | 6996 | 7011 | CCGCCCTCGAGGAACC | 16[†] | 2840 |
| 1129398 | 1753 | 1768 | 7141 | 7156 | AGCTTGGTCCTCACAC | 22[†] | 2841 |

TABLE 48-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129418 | 1806 | 1821 | 7194 | 7209 | CCACAGCCCGATCCCC | 36 | 2842 |
| 1129438 | 1844 | 1859 | 7232 | 7247 | AGGCCACATCGGTGTA | 34 | 2843 |
| 1129458 | 1878 | 1893 | 7266 | 7281 | GAAACGGTGTGCTCCC | 21 | 2844 |
| 1129478 | 1903 | 1918 | 7291 | 7306 | GAAAGATGAGTCCCTG | 15 | 2845 |
| 1129498 | 1950 | 1965 | 7338 | 7353 | GCCTTCCATGCCCCAG | 16 | 2846 |
| 1129518 | 1995 | 2010 | 7383 | 7398 | TCCTGGCGCGGAGCTG | 22 | 2847 |
| 1129538 | 2017 | 2032 | 7405 | 7420 | ACTTTATTGAGTTCCT | 9 | 2848 |
| 1129558 | N/A | N/A | 126 | 141 | AATCCTGGGACAATCC | 77 | 2849 |
| 1129578 | N/A | N/A | 207 | 222 | ACATAGGCCTCCTAGT | 83 | 2850 |
| 1129598 | N/A | N/A | 405 | 420 | GATCTGTTGCTAGTCT | 77 | 2851 |
| 1129618 | N/A | N/A | 466 | 481 | GGTGGAATCTACAAGG | 107 | 2852 |
| 1129638 | N/A | N/A | 613 | 628 | CAGGTAGGCACTAGAC | 76 | 2853 |
| 1129658 | N/A | N/A | 660 | 675 | ACACAGCTCACGATCA | 63 | 2854 |
| 1129678 | N/A | N/A | 959 | 974 | AAATCCCTCGCCCAGA | 62 | 2855 |
| 1129698 | N/A | N/A | 1132 | 1147 | GTACCCTTCATCTAAA | 83 | 2856 |
| 1129718 | N/A | N/A | 1562 | 1577 | CACCAGGGTAAGGTCC | 64 | 2857 |
| 1129738 | N/A | N/A | 1717 | 1732 | GGATTAGGCAAGGATA | 76 | 2858 |
| 1129758 | N/A | N/A | 2282 | 2297 | CATCGCGAATAATGAG | 49 | 2859 |
| 1129778 | N/A | N/A | 2469 | 2484 | CTATAGTGCCATCAGC | 56 | 2860 |
| 1129798 | N/A | N/A | 2631 | 2646 | CAGTCTACTTAGTGCA | 63 | 2861 |
| 1129818 | N/A | N/A | 2963 | 2978 | GAAGAGCACTTGCCAC | 51 | 2862 |
| 1129838 | N/A | N/A | 3404 | 3419 | AAGGTCGCTGTGCATT | 58 | 2863 |
| 1129858 | N/A | N/A | 3882 | 3897 | AGTAATGAGGCGGGAG | 58 | 2864 |
| 1129878 | N/A | N/A | 4045 | 4060 | TTGTGACCTTGCTACT | 50 | 2865 |
| 1129898 | N/A | N/A | 4323 | 4338 | TCCGAGTATCCAGCAA | 68 | 2866 |
| 1129918 | N/A | N/A | 4366 | 4381 | AGAGGGATAGTGGTCT | 88 | 2867 |
| 1129938 | N/A | N/A | 4635 | 4650 | ACGCAGTGAGCCACCC | 43 | 2868 |
| 1129958 | N/A | N/A | 5075 | 5090 | CACGCGGCGCACCGGC | 66 | 2869 |
| 1129978 | N/A | N/A | 5423 | 5438 | GGAATCTAGCTCGCCC | 74 | 2870 |
| 1129998 | N/A | N/A | 5483 | 5498 | TCGCCGGCAAGGCTGT | 80 | 2871 |
| 1130018 | N/A | N/A | 5772 | 5787 | CGTGGAAGCTGCGCTG | 75 | 2872 |
| 1130038 | N/A | N/A | 5877 | 5892 | GCTCCCGAACCCCAAT | 69 | 2873 |
| 1130058 | N/A | N/A | 6176 | 6191 | GGCGCAACAGAGCTAA | 59 | 2874 |
| 1130078 | N/A | N/A | 6368 | 6383 | CGCCTAACCCAGTGAT | 71 | 2875 |
| 1130098 | N/A | N/A | 6394 | 6409 | ACGATACCAAAGTCGC | 68 | 2876 |

TABLE 48-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130118 | N/A | N/A | 6457 | 6472 | GGATTCACCTACACAT | 73 | 2877 |
| 1130138 | N/A | N/A | 6568 | 6583 | GCCTTTGCAGCCCGGC | 98 | 2878 |
| 1130158 | N/A | N/A | 6630 | 6645 | ATCCAGAGTCGCAGAA | 62 | 2879 |
| 1130178 | N/A | N/A | 6754 | 6769 | CGCAGCAAGCCCGAAG | 69 | 2880 |
| 1130198 | N/A | N/A | 6817 | 6832 | CCGCCCGGACGATGGA | 78 | 2881 |
| 1130218 | N/A | N/A | 7018 | 7033 | GCTCACCTGGCACGCA | 98† | 2882 |
| 1130238 | N/A | N/A | 7096 | 7111 | CGGAAACACGCAGCTC | 79† | 2883 |

TABLE 49

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128738 | 92 | 107 | N/A | N/A | TCGAAAGTGTTGACTC | 15 | 2884 |
| 1128758 | 132 | 147 | 499 | 514 | GCTTTGTACTTATGCT | 63 | 2885 |
| 1128778 | 163 | 178 | N/A | N/A | GGTGACAGTGAGAACG | 19 | 2886 |
| 1128798 | 214 | 229 | 3565 | 3580 | TTTGTGGTACAGCTGC | 28 | 2887 |
| 1128802 | 218 | 233 | 3569 | 3584 | TACATTTGTGGTACAG | 16 | 2426 |
| 1128819 | 245 | 260 | 3596 | 3611 | GCTGAGGGCCTGGCCG | 59 | 2888 |
| 1128839 | 301 | 316 | 3808 | 3823 | CAAACAGTATCCCCAT | 24 | 2889 |
| 1128859 | 424 | 439 | 4232 | 4247 | GCAGTGGTTTCCAGTG | 17 | 2890 |
| 1128879 | 494 | 509 | 4439 | 4454 | CAGTTCTATACCATAT | 15 | 2891 |
| 1128899 | 582 | 597 | 4666 | 4681 | CACGGGTTGGTGCGGC | 33 | 2892 |
| 1128919 | 604 | 619 | 4688 | 4703 | TAGGCAGCGACCCCCA | 31 | 2893 |
| 1128939 | 645 | 660 | 4729 | 4744 | TAGCCCACCGGGCAGT | 40 | 2894 |
| 1128959 | 690 | 705 | 4919 | 4934 | TCATAGCAGCTTGCCT | 22 | 2895 |
| 1128979 | 744 | 759 | 4973 | 4988 | GGCGCACCCGAGAGCG | 32 | 2896 |
| 1128999 | 768 | 783 | 4997 | 5012 | GCCTCCGAGGCCCACG | 46 | 2897 |
| 1129019 | 813 | 828 | 5042 | 5057 | AGTCCCCAGTTCCGCG | 39 | 2898 |
| 1129039 | 871 | 886 | 5185 | 5200 | CACGAAGCACCACGGG | 16 | 2899 |
| 1129059 | 908 | 923 | 5222 | 5237 | GGTCGCAGTACTCCCA | 18 | 2900 |
| 1129079 | 996 | 1011 | 5310 | 5325 | GCCGGCTGCGCGGGCA | 35 | 2901 |
| 1129099 | 1064 | 1079 | N/A | N/A | TCGCCGGCAAGGCTCC | 36 | 2902 |
| 1129119 | 1107 | 1122 | 5526 | 5541 | CTCAGTGGGCCGTTCC | 17 | 2903 |
| 1129139 | 1135 | 1150 | 5554 | 5569 | CAGACTCTTGCGGAGC | 12 | 2904 |

TABLE 49-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129159 | 1159 | 1174 | 5578 | 5593 | GCCAACGACGCGGGTC | 27 | 2905 |
| 1129179 | 1222 | 1237 | 5641 | 5656 | GAAACTGTGGCCCCAG | 18 | 2906 |
| 1129199 | 1286 | 1301 | 5705 | 5720 | GCCGGTCCTGCAGGCA | 33 | 2907 |
| 1129219 | 1353 | 1368 | 6013 | 6028 | TGGCACGGCTCACAGC | 27 | 2908 |
| 1129239 | 1403 | 1418 | 6063 | 6078 | TGACGGGCGAGAAGGC | 47 | 2909 |
| 1129259 | 1445 | 1460 | 6188 | 6203 | CATCCTCCTGAAGGCG | 32 | 2910 |
| 1129279 | 1470 | 1485 | 6213 | 6228 | GACAGGAGCGCGCAGC | 27 | 2911 |
| 1129299 | 1505 | 1520 | 6248 | 6263 | CGCCGCTTGGCAGGCA | 59 | 2912 |
| 1129319 | 1564 | 1579 | 6307 | 6322 | CTCGAACTGGTGGCCC | 37 | 2913 |
| 1129339 | 1592 | 1607 | 6890 | 6905 | GCAGGAAGCTGGCATA | 72 | 2914 |
| 1129359 | 1660 | 1675 | 6958 | 6973 | GATGGAGGATCCGTGC | 11† | 2915 |
| 1129379 | 1699 | 1714 | 6997 | 7012 | GCCGCCCTCGAGGAAC | 6† | 2916 |
| 1129399 | 1754 | 1769 | 7142 | 7157 | CAGCTTGGTCCTCACA | 26† | 2917 |
| 1129419 | 1808 | 1823 | 7196 | 7211 | CACCACAGCCCGATCC | 37 | 2918 |
| 1129439 | 1845 | 1860 | 7233 | 7248 | TAGGCCACATCGGTGT | 31 | 2919 |
| 1129459 | 1879 | 1894 | 7267 | 7282 | GGAAACGGTGTGCTCC | 41 | 2920 |
| 1129479 | 1904 | 1919 | 7292 | 7307 | GGAAAGATGAGTCCCT | 15 | 2921 |
| 1129499 | 1951 | 1966 | 7339 | 7354 | TGCCTTCCATGCCCCA | 8 | 2922 |
| 1129519 | 1996 | 2011 | 7384 | 7399 | ATCCTGGCGCGGAGCT | 29 | 2923 |
| 1129539 | 2018 | 2033 | 7406 | 7421 | CACTTTATTGAGTTCC | 6 | 2924 |
| 1129559 | N/A | N/A | 138 | 153 | ACCCCCCAGAACAATC | 45 | 2925 |
| 1129579 | N/A | N/A | 208 | 223 | CACATAGGCCTCCTAG | 24 | 2926 |
| 1129599 | N/A | N/A | 408 | 423 | ACCGATCTGTTGCTAG | 79 | 2927 |
| 1129619 | N/A | N/A | 469 | 484 | CAAGGTGGAATCTACA | 50 | 2928 |
| 1129639 | N/A | N/A | 614 | 629 | CCAGGTAGGCACTAGA | 36 | 2929 |
| 1129659 | N/A | N/A | 693 | 708 | TTAGACACAGCCCATA | 56 | 2930 |
| 1129679 | N/A | N/A | 960 | 975 | CAAATCCCTCGCCCAG | 30 | 2931 |
| 1129699 | N/A | N/A | 1134 | 1149 | AGGTACCCTTCATCTA | 79 | 2932 |
| 1129719 | N/A | N/A | 1583 | 1598 | TCAACCCCACCAAGTC | 59 | 2933 |
| 1129739 | N/A | N/A | 1757 | 1772 | ATGGGATGGACGGACA | 44 | 2934 |
| 1129759 | N/A | N/A | 2283 | 2298 | CCATCGCGAATAATGA | 50 | 2935 |
| 1129779 | N/A | N/A | 2470 | 2485 | GCTATAGTGCCATCAG | 25 | 2936 |
| 1129799 | N/A | N/A | 2651 | 2666 | TATTGAATGAGTGTCC | 36 | 2937 |
| 1129819 | N/A | N/A | 2987 | 3002 | GTAAGTCTTCAGTCCC | 56 | 2938 |
| 1129839 | N/A | N/A | 3405 | 3420 | AAAGGTCGCTGTGCAT | 58 | 2939 |

TABLE 49-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129859 | N/A | N/A | 3883 | 3898 | GAGTAATGAGGCGGGA | 55 | 2940 |
| 1129879 | N/A | N/A | 4058 | 4073 | GAACCTACTTGCCTTG | 42 | 2941 |
| 1129899 | N/A | N/A | 4324 | 4339 | CTCCGAGTATCCAGCA | 28 | 2942 |
| 1129919 | N/A | N/A | 4367 | 4382 | AAGAGGGATAGTGGTC | 48 | 2943 |
| 1129939 | N/A | N/A | 4636 | 4651 | AACGCAGTGAGCCACC | 55 | 2944 |
| 1129959 | N/A | N/A | 5076 | 5091 | CCACGCGGCGCACCGG | 61 | 2945 |
| 1129979 | N/A | N/A | 5424 | 5439 | CGGAATCTAGCTCGCC | 45 | 2946 |
| 1129999 | N/A | N/A | 5484 | 5499 | TTCGCCGGCAAGGCTG | 50 | 2947 |
| 1130019 | N/A | N/A | 5800 | 5815 | AGAAGGTAGGGCACGG | 78 | 2948 |
| 1130039 | N/A | N/A | 6089 | 6104 | CCACGCACCCAGGTCG | 87 | 2949 |
| 1130059 | N/A | N/A | 6177 | 6192 | AGGCGCAACAGAGCTA | 32 | 2950 |
| 1130079 | N/A | N/A | 6369 | 6384 | CCGCCTAACCCAGTGA | 28 | 2951 |
| 1130099 | N/A | N/A | 6395 | 6410 | AACGATACCAAAGTCG | 42 | 2952 |
| 1130119 | N/A | N/A | 6459 | 6474 | TGGGATTCACCTACAC | 94 | 2953 |
| 1130139 | N/A | N/A | 6576 | 6591 | CCTAGTTGGCCTTTGC | 46 | 2954 |
| 1130159 | N/A | N/A | 6634 | 6649 | ACCCATCCAGAGTCGC | 66 | 2955 |
| 1130179 | N/A | N/A | 6755 | 6770 | TCGCAGCAAGCCCGAA | 53 | 2956 |
| 1130199 | N/A | N/A | 6818 | 6833 | GCCGCCCGGACGATGG | 84 | 2957 |
| 1130219 | N/A | N/A | 7026 | 7041 | GGCTAAGAGCTCACCT | 81† | 2958 |
| 1130239 | N/A | N/A | 7097 | 7112 | TCGGAAACACGCAGCT | 65† | 2959 |

TABLE 50

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128739 | 93 | 108 | N/A | N/A | ATCGAAAGTGTTGACT | 23 | 2960 |
| 1128759 | 133 | 148 | 500 | 515 | AGCTTTGTACTTATGC | 13 | 2961 |
| 1128779 | 164 | 179 | 3515 | 3530 | CGGTGACAGTGAGAAC | 14 | 2962 |
| 1128799 | 215 | 230 | 3566 | 3581 | ATTTGTGGTACAGCTG | 7 | 2963 |
| 1128802 | 218 | 233 | 3569 | 3584 | TACATTTGTGGTACAG | 4 | 2426 |
| 1128820 | 257 | 272 | N/A | N/A | TAGCACACCAGGGCTG | 40 | 2964 |
| 1128840 | 302 | 317 | 3809 | 3824 | CCAAACAGTATCCCCA | 10 | 2965 |
| 1128860 | 431 | 446 | 4239 | 4254 | CTTTCTGGCAGTGGTT | 12 | 2966 |
| 1128880 | 497 | 512 | 4442 | 4457 | GCTCAGTTCTATACCA | 2 | 2967 |

TABLE 50-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128900 | 583 | 598 | 4667 | 4682 | GCACGGGTTGGTGCGG | 38 | 2968 |
| 1128920 | 607 | 622 | 4691 | 4706 | CTCTAGGCAGCGACCC | 18 | 2969 |
| 1128940 | 646 | 661 | 4730 | 4745 | GTAGCCCACCGGGCAG | 33 | 2970 |
| 1128960 | 691 | 706 | 4920 | 4935 | ATCATAGCAGCTTGCC | 15 | 2971 |
| 1128980 | 745 | 760 | 4974 | 4989 | GGGCGCACCCGAGAGC | 10 | 2972 |
| 1129000 | 776 | 791 | 5005 | 5020 | GGTAGGTGGCCTCCGA | 10 | 2973 |
| 1129020 | 814 | 829 | 5043 | 5058 | CAGTCCCCAGTTCCGC | 8 | 2974 |
| 1129040 | 872 | 887 | 5186 | 5201 | GCACGAAGCACCACGG | 18 | 2975 |
| 1129060 | 910 | 925 | 5224 | 5239 | CAGGTCGCAGTACTCC | 24 | 2976 |
| 1129080 | 998 | 1013 | 5312 | 5327 | GTGCCGGCTGCGCGGG | 15 | 2977 |
| 1129100 | 1065 | 1080 | N/A | N/A | TTCGCCGGCAAGGCTC | 36 | 2978 |
| 1129120 | 1108 | 1123 | 5527 | 5542 | GCTCAGTGGGCCGTTC | 10 | 2979 |
| 1129140 | 1136 | 1151 | 5555 | 5570 | ACAGACTCTTGCGGAG | 16 | 2980 |
| 1129160 | 1160 | 1175 | 5579 | 5594 | CGCCAACGACGCGGGT | 21 | 2981 |
| 1129180 | 1223 | 1238 | 5642 | 5657 | AGAAACTGTGGCCCCA | 10 | 2982 |
| 1129200 | 1288 | 1303 | N/A | N/A | GGGCCGGTCCTGCAGG | 15 | 2983 |
| 1129220 | 1354 | 1369 | 6014 | 6029 | CTGGCACGGCTCACAG | 23 | 2984 |
| 1129240 | 1404 | 1419 | 6064 | 6079 | CTGACGGGCGAGAAGG | 46 | 2985 |
| 1129260 | 1446 | 1461 | 6189 | 6204 | GCATCCTCCTGAAGGC | 10 | 2986 |
| 1129280 | 1471 | 1486 | 6214 | 6229 | CGACAGGAGCGCGCAG | 39 | 2987 |
| 1129300 | 1518 | 1533 | 6261 | 6276 | GAGGGTCGCGCGGCGC | 24 | 2988 |
| 1129320 | 1565 | 1580 | 6308 | 6323 | CCTCGAACTGGTGGCC | 48 | 2989 |
| 1129340 | 1602 | 1617 | 6900 | 6915 | TGCGCCTCCTGCAGGA | 70 | 2990 |
| 1129360 | 1662 | 1677 | 6960 | 6975 | AGGATGGAGGATCCGT | 43† | 2991 |
| 1129380 | 1700 | 1715 | 6998 | 7013 | TGCCGCCCTCGAGGAA | 10† | 2992 |
| 1129400 | 1755 | 1770 | 7143 | 7158 | GCAGCTTGGTCCTCAC | 8† | 2993 |
| 1129420 | 1811 | 1826 | 7199 | 7214 | GGTCACCACAGCCCGA | 9 | 2994 |
| 1129440 | 1846 | 1861 | 7234 | 7249 | GTAGGCCACATCGGTG | 12 | 2995 |
| 1129460 | 1880 | 1895 | 7268 | 7283 | AGGAAACGGTGTGCTC | 7 | 2996 |
| 1129480 | 1905 | 1920 | 7293 | 7308 | GGGAAAGATGAGTCCC | 39 | 2997 |
| 1129500 | 1952 | 1967 | 7340 | 7355 | TTGCCTTCCATGCCCC | 4 | 2998 |
| 1129520 | 1997 | 2012 | 7385 | 7400 | CATCCTGGCGCGGAGC | 15 | 2999 |
| 1129540 | 2019 | 2034 | 7407 | 7422 | GCACTTTATTGAGTTC | 3 | 3000 |
| 1129560 | N/A | N/A | 139 | 154 | GACCCCCAGAACAAT | 20 | 3001 |
| 1129580 | N/A | N/A | 216 | 231 | CACCTTTCCACATAGG | 44 | 3002 |

TABLE 50-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129600 | N/A | N/A | 409 | 424 | CACCGATCTGTTGCTA | 77 | 3003 |
| 1129620 | N/A | N/A | 470 | 485 | CCAAGGTGGAATCTAC | 34 | 3004 |
| 1129640 | N/A | N/A | 615 | 630 | ACCAGGTAGGCACTAG | 23 | 3005 |
| 1129660 | N/A | N/A | 694 | 709 | CTTAGACACAGCCCAT | 58 | 3006 |
| 1129680 | N/A | N/A | 963 | 978 | ACTCAAATCCCTCGCC | 23 | 3007 |
| 1129700 | N/A | N/A | 1136 | 1151 | GCAGGTACCCTTCATC | 22 | 3008 |
| 1129720 | N/A | N/A | 1586 | 1601 | GACTCAACCCCACCAA | 32 | 3009 |
| 1129740 | N/A | N/A | 1758 | 1773 | GATGGGATGGACGGAC | 16 | 3010 |
| 1129760 | N/A | N/A | 2284 | 2299 | ACCATCGCGAATAATG | 14 | 3011 |
| 1129780 | N/A | N/A | 2487 | 2502 | ACTTGATTCAGGTGTG | 29 | 3012 |
| 1129800 | N/A | N/A | 2652 | 2667 | CTATTGAATGAGTGTC | 47 | 3013 |
| 1129820 | N/A | N/A | 2989 | 3004 | GGGTAAGTCTTCAGTC | 33 | 3014 |
| 1129840 | N/A | N/A | 3406 | 3421 | AAAAGGTCGCTGTGCA | 49 | 3015 |
| 1129860 | N/A | N/A | 3884 | 3899 | AGAGTAATGAGGCGGG | 27 | 3016 |
| 1129880 | N/A | N/A | 4059 | 4074 | TGAACCTACTTGCCTT | 21 | 3017 |
| 1129900 | N/A | N/A | 4325 | 4340 | TCTCCGAGTATCCAGC | 34 | 3018 |
| 1129920 | N/A | N/A | 4529 | 4544 | CGTTCCCAACCATCTG | 56 | 3019 |
| 1129940 | N/A | N/A | 4637 | 4652 | GAACGCAGTGAGCCAC | 21 | 3020 |
| 1129960 | N/A | N/A | 5078 | 5093 | CCCCACGCGGCGCACC | 44 | 3021 |
| 1129980 | N/A | N/A | 5425 | 5440 | CCGGAATCTAGCTCGC | 32 | 3022 |
| 1130000 | N/A | N/A | 5706 | 5721 | CGCCGGTCCTGCAGGC | 32 | 3023 |
| 1130020 | N/A | N/A | 5801 | 5816 | GAGAAGGTAGGGCACG | 30 | 3024 |
| 1130040 | N/A | N/A | 6112 | 6127 | CTTCCCGTCCCCGCGG | 45 | 3025 |
| 1130060 | N/A | N/A | 6178 | 6193 | AAGGCGCAACAGAGCT | 19 | 3026 |
| 1130080 | N/A | N/A | 6370 | 6385 | TCCGCCTAACCCAGTG | 76 | 3027 |
| 1130100 | N/A | N/A | 6396 | 6411 | GAACGATACCAAAGTC | 38 | 3028 |
| 1130120 | N/A | N/A | 6462 | 6477 | ACCTGGGATTCACCTA | 31 | 3029 |
| 1130140 | N/A | N/A | 6577 | 6592 | TCCTAGTTGGCCTTTG | 23 | 3030 |
| 1130160 | N/A | N/A | 6659 | 6674 | CGGAAACAGAAACCCC | 57 | 3031 |
| 1130180 | N/A | N/A | 6756 | 6771 | CTCGCAGCAAGCCCGA | 46 | 3032 |
| 1130200 | N/A | N/A | 6819 | 6834 | TGCCGCCCGGACGATG | 26 | 3033 |
| 1130220 | N/A | N/A | 7028 | 7043 | CGGGCTAAGAGCTCAC | 26† | 3034 |
| 1130240 | N/A | N/A | 7098 | 7113 | GTCGGAAACACGCAGC | 15† | 3035 |

TABLE 51

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128740 | 94 | 109 | N/A | N/A | AATCGAAAGTGTTGAC | 55 | 3036 |
| 1128760 | 143 | 158 | 510 | 525 | TGTGCTCTTCAGCTTT | 23 | 3037 |
| 1128780 | 165 | 180 | 3516 | 3531 | CCGGTGACAGTGAGAA | 29 | 3038 |
| 1128800 | 216 | 231 | 3567 | 3582 | CATTTGTGGTACAGCT | 20 | 3039 |
| 1128802 | 218 | 233 | 3569 | 3584 | TACATTTGTGGTACAG | 16 | 2426 |
| 1128821 | 261 | 276 | N/A | N/A | GTGGTAGCACACCAGG | 19 | 3040 |
| 1128841 | 303 | 318 | 3810 | 3825 | TCCAAACAGTATCCCC | 16 | 3041 |
| 1128861 | 432 | 447 | N/A | N/A | TCTTTCTGGCAGTGGT | 31 | 3042 |
| 1128881 | 528 | 543 | 4473 | 4488 | CCCTTGCACTGGCATC | 17 | 3043 |
| 1128901 | 584 | 599 | 4668 | 4683 | GGCACGGGTTGGTGCG | 69 | 3044 |
| 1128921 | 608 | 623 | 4692 | 4707 | CCTCTAGGCAGCGACC | 32 | 3045 |
| 1128941 | 648 | 663 | 4732 | 4747 | GTGTAGCCCACCGGGC | 84 | 3046 |
| 1128961 | 692 | 707 | 4921 | 4936 | CATCATAGCAGCTTGC | 28 | 3047 |
| 1128981 | 746 | 761 | 4975 | 4990 | AGGGCGCACCCGAGAG | 25 | 3048 |
| 1129001 | 777 | 792 | 5006 | 5021 | CGGTAGGTGGCCTCCG | 57 | 3049 |
| 1129021 | 815 | 830 | 5044 | 5059 | CCAGTCCCCAGTTCCG | 39 | 3050 |
| 1129041 | 873 | 888 | 5187 | 5202 | AGCACGAAGCACCACG | 25 | 3051 |
| 1129061 | 911 | 926 | 5225 | 5240 | CCAGGTCGCAGTACTC | 21 | 3052 |
| 1129081 | 1001 | 1016 | 5315 | 5330 | GCGGTGCCGGCTGCGC | 73 | 3053 |
| 1129101 | 1066 | 1081 | 5485 | 5500 | CTTCGCCGGCAAGGCT | 36 | 3054 |
| 1129121 | 1112 | 1127 | 5531 | 5546 | CGCAGCTCAGTGGGCC | 46 | 3055 |
| 1129141 | 1137 | 1152 | 5556 | 5571 | GACAGACTCTTGCGGA | 23 | 3056 |
| 1129161 | 1161 | 1176 | 5580 | 5595 | CCGCCAACGACGCGGG | 38 | 3057 |
| 1129181 | 1224 | 1239 | 5643 | 5658 | CAGAAACTGTGGCCCC | 29 | 3058 |
| 1129201 | 1289 | 1304 | N/A | N/A | CGGGCCGGTCCTGCAG | 58 | 3059 |
| 1129221 | 1357 | 1372 | 6017 | 6032 | CGTCTGGCACGGCTCA | 12 | 3060 |
| 1129241 | 1405 | 1420 | 6065 | 6080 | GCTGACGGGCGAGAAG | 30 | 3061 |
| 1129261 | 1448 | 1463 | 6191 | 6206 | CCGCATCCTCCTGAAG | 46 | 3062 |
| 1129281 | 1472 | 1487 | 6215 | 6230 | GCGACAGGAGCGCGCA | 59 | 3063 |
| 1129301 | 1519 | 1534 | 6262 | 6277 | GGAGGGTCGCGCGGCG | 61 | 3064 |
| 1129321 | 1566 | 1581 | 6309 | 6324 | CCCTCGAACTGGTGGC | 70 | 3065 |
| 1129341 | 1606 | 1621 | 6904 | 6919 | TACCTGCGCCTCCTGC | 90 | 3066 |
| 1129361 | 1663 | 1678 | 6961 | 6976 | GAGGATGGAGGATCCG | 43† | 3067 |
| 1129381 | 1704 | 1719 | 7002 | 7017 | TCGGTGCCGCCCTCGA | 32† | 3068 |
| 1129401 | 1759 | 1774 | 7147 | 7162 | CTCTGCAGCTTGGTCC | 32† | 3069 |
| 1129421 | 1814 | 1829 | 7202 | 7217 | TGCGGTCACCACAGCC | 22 | 3070 |

TABLE 51-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129441 | 1847 | 1862 | 7235 | 7250 | AGTAGGCCACATCGGT | 13 | 3071 |
| 1129461 | 1881 | 1896 | 7269 | 7284 | CAGGAAACGGTGTGCT | 25 | 3072 |
| 1129481 | 1906 | 1921 | 7294 | 7309 | AGGGAAAGATGAGTCC | 10 | 3073 |
| 1129501 | 1954 | 1969 | 7342 | 7357 | TCTTGCCTTCCATGCC | 14 | 3074 |
| 1129521 | 1998 | 2013 | 7386 | 7401 | CCATCCTGGCGCGGAG | 28 | 3075 |
| 1129541 | 2020 | 2035 | 7408 | 7423 | AGCACTTTATTGAGTT | 8 | 3076 |
| 1129561 | N/A | N/A | 140 | 155 | CGACCCCCAGAACAA | 72 | 3077 |
| 1129581 | N/A | N/A | 229 | 244 | TCCGGGCTGGCCTCAC | 81 | 3078 |
| 1129601 | N/A | N/A | 410 | 425 | CCACCGATCTGTTGCT | 56 | 3079 |
| 1129621 | N/A | N/A | 520 | 535 | TTACCGACTGTGTGCT | 30 | 3080 |
| 1129641 | N/A | N/A | 619 | 634 | TAGCACCAGGTAGGCA | 64 | 3081 |
| 1129661 | N/A | N/A | 697 | 712 | GCACTTAGACACAGCC | 88 | 3082 |
| 1129681 | N/A | N/A | 964 | 979 | AACTCAAATCCCTCGC | 70 | 3083 |
| 1129701 | N/A | N/A | 1137 | 1152 | GGCAGGTACCCTTCAT | 151 | 3084 |
| 1129721 | N/A | N/A | 1590 | 1605 | TAGAGACTCAACCCCA | 62 | 3085 |
| 1129741 | N/A | N/A | 1761 | 1776 | GCAGATGGGATGGACG | 42 | 3086 |
| 1129761 | N/A | N/A | 2285 | 2300 | AACCATCGCGAATAAT | 50 | 3087 |
| 1129781 | N/A | N/A | 2489 | 2504 | ACACTTGATTCAGGTG | 49 | 3088 |
| 1129801 | N/A | N/A | 2653 | 2668 | CCTATTGAATGAGTGT | 54 | 3089 |
| 1129821 | N/A | N/A | 2991 | 3006 | TTGGGTAAGTCTTCAG | 51 | 3090 |
| 1129841 | N/A | N/A | 3407 | 3422 | AAAAAGGTCGCTGTGC | 52 | 3091 |
| 1129861 | N/A | N/A | 3885 | 3900 | GAGAGTAATGAGGCGG | 54 | 3092 |
| 1129881 | N/A | N/A | 4060 | 4075 | TTGAACCTACTTGCCT | 62 | 3093 |
| 1129901 | N/A | N/A | 4326 | 4341 | GTCTCCGAGTATCCAG | 106 | 3094 |
| 1129921 | N/A | N/A | 4532 | 4547 | GCCCGTTCCCAACCAT | 63 | 3095 |
| 1129941 | N/A | N/A | 4639 | 4654 | GGGAACGCAGTGAGCC | 47 | 3096 |
| 1129961 | N/A | N/A | 5080 | 5095 | AGCCCCACGCGGCGCA | 112 | 3097 |
| 1129981 | N/A | N/A | 5426 | 5441 | GCCGGAATCTAGCTCG | 49 | 3098 |
| 1130001 | N/A | N/A | 5707 | 5722 | TCGCCGGTCCTGCAGG | 60 | 3099 |
| 1130021 | N/A | N/A | 5806 | 5821 | GGCGGGAGAAGGTAGG | 51 | 3100 |
| 1130041 | N/A | N/A | 6158 | 6173 | CGGGCGGAGAGGAGCG | 118 | 3101 |
| 1130061 | N/A | N/A | 6310 | 6325 | ACCCTCGAACTGGTGG | 45 | 3102 |
| 1130081 | N/A | N/A | 6371 | 6386 | TTCCGCCTAACCCAGT | 113 | 3103 |
| 1130101 | N/A | N/A | 6397 | 6412 | GGAACGATACCAAAGT | 75 | 3104 |
| 1130121 | N/A | N/A | 6463 | 6478 | TACCTGGGATTCACCT | 59 | 3105 |

TABLE 51-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130141 | N/A | N/A | 6578 | 6593 | GTCCTAGTTGGCCTTT | 29 | 3106 |
| 1130161 | N/A | N/A | 6664 | 6679 | CGGAGCGGAAACAGAA | 109 | 3107 |
| 1130181 | N/A | N/A | 6757 | 6772 | TCTCGCAGCAAGCCCG | 99 | 3108 |
| 1130201 | N/A | N/A | 6823 | 6838 | CGCTTGCCGCCCGGAC | 48 | 3109 |
| 1130221 | N/A | N/A | 7029 | 7044 | CCGGGCTAAGAGCTCA | 48† | 3110 |
| 1130241 | N/A | N/A | 7099 | 7114 | GGTCGGAAACACGCAG | 77† | 3111 |

TABLE 52

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128761 | 145 | 160 | 512 | 527 | TGTGTGCTCTTCAGCT | 19 | 3112 |
| 1128781 | 166 | 181 | 3517 | 3532 | CCCGGTGACAGTGAGA | 18 | 3113 |
| 1128801 | 217 | 232 | 3568 | 3583 | ACATTTGTGGTACAGC | 8 | 3114 |
| 1128802 | 218 | 233 | 3569 | 3584 | TACATTTGTGGTACAG | 9 | 2426 |
| 1128862 | 462 | 477 | 4407 | 4422 | AACCGGAGAAGCTGAG | 24 | 3115 |
| 1128882 | 529 | 544 | 4474 | 4489 | ACCCTTGCACTGGCAT | 32 | 3116 |
| 1128902 | 585 | 600 | 4669 | 4684 | AGGCACGGGTTGGTGC | 70 | 3117 |
| 1128922 | 609 | 624 | 4693 | 4708 | ACCTCTAGGCAGCGAC | 19 | 3118 |
| 1128942 | 650 | 665 | 4734 | 4749 | CGGTGTAGCCCACCGG | 67 | 3119 |
| 1128962 | 693 | 708 | 4922 | 4937 | CCATCATAGCAGCTTG | 22 | 3120 |
| 1128982 | 747 | 762 | 4976 | 4991 | CAGGGCGCACCCGAGA | 27 | 3121 |
| 1129002 | 778 | 793 | 5007 | 5022 | CCGGTAGGTGGCCTCC | 32 | 3122 |
| 1129022 | 823 | 838 | 5052 | 5067 | GTGGCCGCCCAGTCCC | 17 | 3123 |
| 1129042 | 874 | 889 | 5188 | 5203 | CAGCACGAAGCACCAC | 21 | 3124 |
| 1129062 | 912 | 927 | 5226 | 5241 | GCCAGGTCGCAGTACT | 25 | 3125 |
| 1129082 | 1003 | 1018 | 5317 | 5332 | CGGCGGTGCCGGCTGC | 25 | 3126 |
| 1129102 | 1068 | 1083 | 5487 | 5502 | CGCTTCGCCGGCAAGG | 30 | 3127 |
| 1129122 | 1113 | 1128 | 5532 | 5547 | CCGCAGCTCAGTGGGC | 40 | 3128 |
| 1129142 | 1138 | 1153 | 5557 | 5572 | AGACAGACTCTTGCGG | 15 | 3129 |
| 1129162 | 1162 | 1177 | 5581 | 5596 | CCCGCCAACGACGCGG | 43 | 3130 |
| 1129182 | 1225 | 1240 | 5644 | 5659 | GCAGAAACTGTGGCCC | 33 | 3131 |
| 1129222 | 1371 | 1386 | 6031 | 6046 | GAGCGCACGGCCAACG | 23 | 3132 |
| 1129242 | 1406 | 1421 | 6066 | 6081 | AGCTGACGGGCGAGAA | 59 | 3133 |

TABLE 52-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129262 | 1449 | 1464 | 6192 | 6207 | TCCGCATCCTCCTGAA | 55 | 3134 |
| 1129282 | 1473 | 1488 | 6216 | 6231 | GGCGACAGGAGCGCGC | 34 | 3135 |
| 1129302 | 1520 | 1535 | 6263 | 6278 | CGGAGGGTCGCGCGGC | 65 | 3136 |
| 1129342 | 1607 | 1622 | 6905 | 6920 | GTACCTGCGCCTCCTG | 82 | 3137 |
| 1129362 | 1679 | 1694 | 6977 | 6992 | CGCAGAGCATGCCGGG | 6† | 3138 |
| 1129382 | 1705 | 1720 | 7003 | 7018 | ATCGGTGCCGCCCTCG | 8† | 3139 |
| 1129402 | 1774 | 1789 | 7162 | 7177 | CAGGGTGAGCCGGCGC | 31 | 3140 |
| 1129422 | 1815 | 1830 | 7203 | 7218 | TTGCGGTCACCACAGC | 27 | 3141 |
| 1129442 | 1848 | 1863 | 7236 | 7251 | TAGTAGGCCACATCGG | 19 | 3142 |
| 1129462 | 1882 | 1897 | 7270 | 7285 | TCAGGAAACGGTGTGC | 18 | 3143 |
| 1129482 | 1908 | 1923 | 7296 | 7311 | GGAGGGAAAGATGAGT | 15 | 3144 |
| 1129502 | 1955 | 1970 | 7343 | 7358 | ATCTTGCCTTCCATGC | 9 | 3145 |
| 1129522 | 1999 | 2014 | 7387 | 7402 | GCCATCCTGGCGCGGA | 51 | 3146 |
| 1129542 | 2021 | 2036 | 7409 | 7424 | AAGCACTTTATTGAGT | 12 | 3147 |
| 1129562 | N/A | N/A | 141 | 156 | GCGACCCCCAGAACA | 72 | 3148 |
| 1129582 | N/A | N/A | 230 | 245 | TTCCGGGCTGGCCTCA | 52 | 3149 |
| 1129602 | N/A | N/A | 411 | 426 | GCCACCGATCTGTTGC | 82 | 3150 |
| 1129622 | N/A | N/A | 521 | 536 | CTTACCGACTGTGTGC | 52 | 3151 |
| 1129642 | N/A | N/A | 623 | 638 | GACCTAGCACCAGGTA | 103 | 3152 |
| 1129662 | N/A | N/A | 699 | 714 | GGGCACTTAGACACAG | 55 | 3153 |
| 1129682 | N/A | N/A | 965 | 980 | GAACTCAAATCCCTCG | 49 | 3154 |
| 1129702 | N/A | N/A | 1138 | 1153 | TGGCAGGTACCCTTCA | 62 | 3155 |
| 1129722 | N/A | N/A | 1591 | 1606 | TTAGAGACTCAACCCC | 62 | 3156 |
| 1129742 | N/A | N/A | 1916 | 1931 | CATGAAGTTGTGTGCC | 67 | 3157 |
| 1129762 | N/A | N/A | 2287 | 2302 | ATAACCATCGCGAATA | 36 | 3158 |
| 1129782 | N/A | N/A | 2490 | 2505 | GACACTTGATTCAGGT | 45 | 3159 |
| 1129802 | N/A | N/A | 2654 | 2669 | TCCTATTGAATGAGTG | 23 | 3160 |
| 1129822 | N/A | N/A | 3016 | 3031 | TCCACAACCTGCTAGC | 74 | 3161 |
| 1129842 | N/A | N/A | 3408 | 3423 | CAAAAGGTCGCTGTG | 59 | 3162 |
| 1129862 | N/A | N/A | 3886 | 3901 | GGAGAGTAATGAGGCG | 44 | 3163 |
| 1129882 | N/A | N/A | 4061 | 4076 | CTTGAACCTACTTGCC | 50 | 3164 |
| 1129902 | N/A | N/A | 4328 | 4343 | AAGTCTCCGAGTATCC | 61 | 3165 |
| 1129922 | N/A | N/A | 4534 | 4549 | TGGCCCGTTCCCAACC | 46 | 3166 |
| 1129942 | N/A | N/A | 4805 | 4820 | AAGCCCGTCCCACCTG | 46 | 3167 |
| 1129962 | N/A | N/A | 5084 | 5099 | ACCCAGCCCCACGCGG | 60 | 3168 |

TABLE 52-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129982 | N/A | N/A | 5428 | 5443 | TGGCCGGAATCTAGCT | 119 | 3169 |
| 1130002 | N/A | N/A | 5708 | 5723 | CTCGCCGGTCCTGCAG | 54 | 3170 |
| 1130022 | N/A | N/A | 5823 | 5838 | CGTGGAAAGAAGGGTG | 78 | 3171 |
| 1130042 | N/A | N/A | 6159 | 6174 | CCGGGCGGAGAGGAGC | 87 | 3172 |
| 1130062 | N/A | N/A | 6311 | 6326 | TACCCTCGAACTGGTG | 69 | 3173 |
| 1130082 | N/A | N/A | 6373 | 6388 | TCTTCCGCCTAACCCA | 74 | 3174 |
| 1130102 | N/A | N/A | 6398 | 6413 | CGGAACGATACCAAAG | 47 | 3175 |
| 1130122 | N/A | N/A | 6464 | 6479 | CTACCTGGGATTCACC | 85 | 3176 |
| 1130142 | N/A | N/A | 6579 | 6594 | CGTCCTAGTTGGCCTT | 33 | 3177 |
| 1130162 | N/A | N/A | 6665 | 6680 | GCGGAGCGGAAACAGA | 67 | 3178 |
| 1130182 | N/A | N/A | 6759 | 6774 | TCTCTCGCAGCAAGCC | 47 | 3179 |
| 1130202 | N/A | N/A | 6836 | 6851 | CCCCATCTGACAACGC | 103 | 3180 |
| 1130222 | N/A | N/A | 7030 | 7045 | ACCGGGCTAAGAGCTC | 69† | 3181 |
| 1130242 | N/A | N/A | 7100 | 7115 | GGGTCGGAAACACGCA | 94† | 3182 |
| 1128741 | 95 | 110 | N/A | N/A | GAATCGAAAGTGTTGA | 28 | 3183 |
| 1128822 | 263 | 278 | N/A | N/A | GGGTGGTAGCACACCA | 36 | 3184 |
| 1128842 | 327 | 342 | N/A | N/A | CAGTGGTCTTTCACTT | 91 | 3185 |
| 1129202 | 1291 | 1306 | N/A | N/A | TGCGGGCCGGTCCTGC | 63 | 3186 |
| 1129322 | 1567 | 1582 | N/A | N/A | CCCCTCGAACTGGTGG | 86 | 3187 |

TABLE 53

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1128722 | 27 | 42 | 27 | 42 | GTCCGTTGGTCCAGCT | 34 | 3188 |
| 1128742 | 96 | 111 | N/A | N/A | GGAATCGAAAGTGTTG | 19 | 3189 |
| 1128762 | 146 | 161 | 513 | 528 | CTGTGTGCTCTTCAGC | 11 | 3190 |
| 1128782 | 168 | 183 | 3519 | 3534 | TCCCCGGTGACAGTGA | 16 | 3191 |
| 1128802 | 218 | 233 | 3569 | 3584 | TACATTTGTGGTACAG | 7 | 2426 |
| 1128803 | 219 | 234 | 3570 | 3585 | GTACATTTGTGGTACA | 41 | 3192 |
| 1128823 | 278 | 293 | 3785 | 3800 | CCTGATCAAAGTTGGG | 25 | 3193 |
| 1128843 | 328 | 343 | N/A | N/A | GCAGTGGTCTTTCACT | 34 | 3194 |
| 1128863 | 463 | 478 | 4408 | 4423 | AAACCGGAGAAGCTGA | 34 | 3195 |
| 1128883 | 531 | 546 | 4476 | 4491 | GGACCCTTGCACTGGC | 33 | 3196 |

TABLE 53-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1128903 | 586 | 601 | 4670 | 4685 | GAGGCACGGGTTGGTG | 33 | 3197 |
| 1128923 | 610 | 625 | 4694 | 4709 | CACCTCTAGGCAGCGA | 26 | 3198 |
| 1128943 | 651 | 666 | 4735 | 4750 | CCGGTGTAGCCCACCG | 45 | 3199 |
| 1128963 | 695 | 710 | 4924 | 4939 | GGCCATCATAGCAGCT | 35 | 3200 |
| 1128983 | 748 | 763 | 4977 | 4992 | ACAGGGCGCACCCGAG | 19 | 3201 |
| 1129003 | 779 | 794 | 5008 | 5023 | TCCGGTAGGTGGCCTC | 32 | 3202 |
| 1129023 | 838 | 853 | N/A | N/A | GTTCCGGCAGAAGGCG | 20 | 3203 |
| 1129043 | 877 | 892 | 5191 | 5206 | GTTCAGCACGAAGCAC | 14 | 3204 |
| 1129063 | 913 | 928 | 5227 | 5242 | TGCCAGGTCGCAGTAC | 37 | 3205 |
| 1129083 | 1004 | 1019 | 5318 | 5333 | TCGGCGGTGCCGGCTG | 18 | 3206 |
| 1129103 | 1069 | 1084 | 5488 | 5503 | CCGCTTCGCCGGCAAG | 44 | 3207 |
| 1129123 | 1114 | 1129 | 5533 | 5548 | CCCGCAGCTCAGTGGG | 35 | 3208 |
| 1129143 | 1139 | 1154 | 5558 | 5573 | AAGACAGACTCTTGCG | 16 | 3209 |
| 1129163 | 1163 | 1178 | 5582 | 5597 | GCCCGCCAACGACGCG | 39 | 3210 |
| 1129183 | 1226 | 1241 | 5645 | 5660 | CGCAGAAACTGTGGCC | 36 | 3211 |
| 1129203 | 1292 | 1307 | N/A | N/A | GTGCGGGCCGGTCCTG | 62 | 3212 |
| 1129223 | 1373 | 1388 | 6033 | 6048 | AGGAGCGCACGGCCAA | 27 | 3213 |
| 1129243 | 1411 | 1426 | 6071 | 6086 | CTGGTAGCTGACGGGC | 24 | 3214 |
| 1129263 | 1450 | 1465 | 6193 | 6208 | GTCCGCATCCTCCTGA | 40 | 3215 |
| 1129283 | 1474 | 1489 | 6217 | 6232 | AGGCGACAGGAGCGCG | 20 | 3216 |
| 1129303 | 1521 | 1536 | 6264 | 6279 | TCGGAGGGTCGCGCGG | 48 | 3217 |
| 1129323 | 1568 | 1583 | N/A | N/A | CCCCCTCGAACTGGTG | 58 | 3218 |
| 1129343 | 1609 | 1624 | 6907 | 6922 | CGGTACCTGCGCCTCC | 87 | 3219 |
| 1129363 | 1680 | 1695 | 6978 | 6993 | GCGCAGAGCATGCCGG | 44† | 3220 |
| 1129383 | 1706 | 1721 | 7004 | 7019 | CATCGGTGCCGCCCTC | 15† | 3221 |
| 1129403 | 1775 | 1790 | 7163 | 7178 | GCAGGGTGAGCCGGCG | 27 | 3222 |
| 1129423 | 1817 | 1832 | 7205 | 7220 | TGTTGCGGTCACCACA | 11 | 3223 |
| 1129443 | 1849 | 1864 | 7237 | 7252 | GTAGTAGGCCACATCG | 20 | 3224 |
| 1129463 | 1883 | 1898 | 7271 | 7286 | ATCAGGAAACGGTGTG | 38 | 3225 |
| 1129483 | 1919 | 1934 | 7307 | 7322 | GGAATCACCAAGGAGG | 5 | 3226 |
| 1129503 | 1957 | 1972 | 7345 | 7360 | CAATCTTGCCTTCCAT | 14 | 3227 |
| 1129523 | 2000 | 2015 | 7388 | 7403 | CGCCATCCTGGCGCGG | 57 | 3228 |
| 1129543 | 2022 | 2037 | 7410 | 7425 | AAAGCACTTTATTGAG | 9 | 3229 |
| 1129563 | N/A | N/A | 142 | 157 | AGCGACCCCCAGAAC | 42 | 3230 |
| 1129583 | N/A | N/A | 232 | 247 | CCTTCCGGGCTGGCCT | 55 | 3231 |

TABLE 53-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1129603 | N/A | N/A | 412 | 427 | TGCCACCGATCTGTTG | 60 | 3232 |
| 1129623 | N/A | N/A | 526 | 541 | GGCCACTTACCGACTG | 78 | 3233 |
| 1129643 | N/A | N/A | 624 | 639 | AGACCTAGCACCAGGT | 53 | 3234 |
| 1129663 | N/A | N/A | 701 | 716 | GTGGGCACTTAGACAC | 63 | 3235 |
| 1129683 | N/A | N/A | 1003 | 1018 | TCAACCTGGTTTCACA | 20 | 3236 |
| 1129703 | N/A | N/A | 1139 | 1154 | ATGGCAGGTACCCTTC | 21 | 3237 |
| 1129723 | N/A | N/A | 1592 | 1607 | CTTAGAGACTCAACCC | 36 | 3238 |
| 1129743 | N/A | N/A | 1917 | 1932 | GCATGAAGTTGTGTGC | 72 | 3239 |
| 1129763 | N/A | N/A | 2288 | 2303 | CATAACCATCGCGAAT | 29 | 3240 |
| 1129783 | N/A | N/A | 2494 | 2509 | GTTAGACACTTGATTC | 21 | 3241 |
| 1129803 | N/A | N/A | 2655 | 2670 | CTCCTATTGAATGAGT | 64 | 3242 |
| 1129823 | N/A | N/A | 3031 | 3046 | GAGTAGACTCCTGACT | 80 | 3243 |
| 1129843 | N/A | N/A | 3409 | 3424 | TCAAAAGGTCGCTGT | 64 | 3244 |
| 1129863 | N/A | N/A | 3895 | 3910 | GTGATACCAGGAGAGT | 36 | 3245 |
| 1129883 | N/A | N/A | 4062 | 4077 | TCTTGAACCTACTTGC | 32 | 3246 |
| 1129903 | N/A | N/A | 4330 | 4345 | CCAAGTCTCCGAGTAT | 68 | 3247 |
| 1129923 | N/A | N/A | 4535 | 4550 | CTGGCCCGTTCCCAAC | 41 | 3248 |
| 1129943 | N/A | N/A | 4808 | 4823 | GGCAAGCCCGTCCCAC | 21 | 3249 |
| 1129963 | N/A | N/A | 5148 | 5163 | CTGTAGCCACACGACG | 85 | 3250 |
| 1129983 | N/A | N/A | 5429 | 5444 | CTGGCCGGAATCTAGC | 92 | 3251 |
| 1130003 | N/A | N/A | 5709 | 5724 | ACTCGCCGGTCCTGCA | 36 | 3252 |
| 1130023 | N/A | N/A | 5841 | 5856 | CCGGGAGCTCCGGAGG | 69 | 3253 |
| 1130043 | N/A | N/A | 6160 | 6175 | CCCGGGCGGAGAGGAG | 85 | 3254 |
| 1130063 | N/A | N/A | 6312 | 6327 | CTACCCTCGAACTGGT | 52 | 3255 |
| 1130083 | N/A | N/A | 6375 | 6390 | CTTCTTCCGCCTAACC | 51 | 3256 |
| 1130103 | N/A | N/A | 6399 | 6414 | CCGGAACGATACCAAA | 72 | 3257 |
| 1130123 | N/A | N/A | 6475 | 6490 | GCCCTGGGATTCTACC | 54 | 3258 |
| 1130143 | N/A | N/A | 6600 | 6615 | TAGCCCGGAGCGCGGG | 61 | 3259 |
| 1130163 | N/A | N/A | 6666 | 6681 | GGCGGAGCGGAAACAG | 49 | 3260 |
| 1130183 | N/A | N/A | 6760 | 6775 | CTCTCTCGCAGCAAGC | 43 | 3261 |
| 1130203 | N/A | N/A | 6838 | 6853 | CACCCCATCTGACAAC | 45 | 3262 |
| 1130223 | N/A | N/A | 7031 | 7046 | AACCGGGCTAAGAGCT | 62† | 3263 |
| 1130243 | N/A | N/A | 7101 | 7116 | TGGGTCGGAAACACGC | 33† | 3264 |

TABLE 54

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1128723 | 29 | 44 | 29 | 44 | CCGTCCGTTGGTCCAG | 25 | 3265 |
| 1128743 | 97 | 112 | N/A | N/A | TGGAATCGAAAGTGTT | 42 | 3266 |
| 1128763 | 147 | 162 | 514 | 529 | ACTGTGTGCTCTTCAG | 20 | 3267 |
| 1128783 | 169 | 184 | 3520 | 3535 | CTCCCCGGTGACAGTG | 36 | 3268 |
| 1128802 | 218 | 233 | 3569 | 3584 | TACATTTGTGGTACAG | 12 | 2426 |
| 1128804 | 220 | 235 | 3571 | 3586 | GGTACATTTGTGGTAC | 39 | 3269 |
| 1128824 | 279 | 294 | 3786 | 3801 | TCCTGATCAAAGTTGG | 32 | 3270 |
| 1128844 | 330 | 345 | N/A | N/A | CTGCAGTGGTCTTTCA | 87 | 3271 |
| 1128864 | 464 | 479 | 4409 | 4424 | AAAACCGGAGAAGCTG | 32 | 3272 |
| 1128884 | 535 | 550 | 4480 | 4495 | ATCAGGACCCTTGCAC | 32 | 3273 |
| 1128904 | 587 | 602 | 4671 | 4686 | GGAGGCACGGGTTGGT | 41 | 3274 |
| 1128924 | 612 | 627 | 4696 | 4711 | TCCACCTCTAGGCAGC | 26 | 3275 |
| 1128944 | 652 | 667 | 4736 | 4751 | TCCGGTGTAGCCCACC | 31 | 3276 |
| 1128964 | 697 | 712 | 4926 | 4941 | GCGGCCATCATAGCAG | 70 | 3277 |
| 1128984 | 749 | 764 | 4978 | 4993 | GACAGGGCGCACCCGA | 28 | 3278 |
| 1129004 | 780 | 795 | 5009 | 5024 | TTCCGGTAGGTGGCCT | 38 | 3279 |
| 1129024 | 839 | 854 | N/A | N/A | GGTTCCGGCAGAAGGC | 27 | 3280 |
| 1129044 | 881 | 896 | 5195 | 5210 | CGCGGTTCAGCACGAA | 21 | 3281 |
| 1129064 | 941 | 956 | 5255 | 5270 | GCGCCGCCTGGGTTGG | 48 | 3282 |
| 1129084 | 1005 | 1020 | 5319 | 5334 | TTCGGCGGTGCCGGCT | 17 | 3283 |
| 1129104 | 1070 | 1085 | 5489 | 5504 | CCCGCTTCGCCGGCAA | 20 | 3284 |
| 1129124 | 1115 | 1130 | 5534 | 5549 | GCCCGCAGCTCAGTGG | 39 | 3285 |
| 1129144 | 1141 | 1156 | 5560 | 5575 | CGAAGACAGACTCTTG | 20 | 3286 |
| 1129164 | 1165 | 1180 | 5584 | 5599 | CAGCCCGCCAACGACG | 47 | 3287 |
| 1129184 | 1227 | 1242 | 5646 | 5661 | GCGCAGAAACTGTGGC | 51 | 3288 |
| 1129204 | 1302 | 1317 | 5962 | 5977 | AGATCCTCGGGTGCGG | 22 | 3289 |
| 1129224 | 1374 | 1389 | 6034 | 6049 | TAGGAGCGCACGGCCA | 27 | 3290 |
| 1129244 | 1412 | 1427 | 6072 | 6087 | GCTGGTAGCTGACGGG | 44 | 3291 |
| 1129264 | 1452 | 1467 | 6195 | 6210 | CCGTCCGCATCCTCCT | 24 | 3292 |
| 1129284 | 1475 | 1490 | 6218 | 6233 | AAGGCGACAGGAGCGC | 21 | 3293 |
| 1129304 | 1522 | 1537 | 6265 | 6280 | CTCGGAGGGTCGCGCG | 26 | 3294 |
| 1129324 | 1569 | 1584 | N/A | N/A | GCCCCCTCGAACTGGT | 110 | 3295 |
| 1129344 | 1610 | 1625 | 6908 | 6923 | ACGGTACCTGCGCCTC | 63 | 3296 |
| 1129364 | 1681 | 1696 | 6979 | 6994 | TGCGCAGAGCATGCCG | 44† | 3297 |
| 1129384 | 1707 | 1722 | 7005 | 7020 | GCATCGGTGCCGCCCT | 36† | 3298 |
| 1129404 | 1776 | 1791 | 7164 | 7179 | TGCAGGGTGAGCCGGC | 54 | 3299 |

TABLE 54-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1129424 | 1819 | 1834 | 7207 | 7222 | CTTGTTGCGGTCACCA | 17 | 3300 |
| 1129444 | 1850 | 1865 | 7238 | 7253 | GGTAGTAGGCCACATC | 23 | 3301 |
| 1129464 | 1884 | 1899 | 7272 | 7287 | AATCAGGAAACGGTGT | 28 | 3302 |
| 1129484 | 1920 | 1935 | 7308 | 7323 | CGGAATCACCAAGGAG | 9 | 3303 |
| 1129504 | 1958 | 1973 | 7346 | 7361 | ACAATCTTGCCTTCCA | 15 | 3304 |
| 1129524 | 2002 | 2017 | 7390 | 7405 | TGCGCCATCCTGGCGC | 42 | 3305 |
| 1129544 | 2023 | 2038 | 7411 | 7426 | CAAAGCACTTTATTGA | 21 | 3306 |
| 1129564 | N/A | N/A | 143 | 158 | TAGCGACCCCCAGAA | 34 | 3307 |
| 1129584 | N/A | N/A | 271 | 286 | GTATCCACCCAGTCTG | 67 | 3308 |
| 1129604 | N/A | N/A | 415 | 430 | GCCTGCCACCGATCTG | 81 | 3309 |
| 1129624 | N/A | N/A | 528 | 543 | CAGGCCACTTACCGAC | 37 | 3310 |
| 1129644 | N/A | N/A | 626 | 641 | TAAGACCTAGCACCAG | 69 | 3311 |
| 1129664 | N/A | N/A | 702 | 717 | CGTGGGCACTTAGACA | 47 | 3312 |
| 1129684 | N/A | N/A | 1004 | 1019 | ATCAACCTGGTTTCAC | 33 | 3313 |
| 1129704 | N/A | N/A | 1203 | 1218 | GTAATTTAGTGTCTGG | 38 | 3314 |
| 1129724 | N/A | N/A | 1593 | 1608 | GCTTAGAGACTCAACC | 60 | 3315 |
| 1129744 | N/A | N/A | 2082 | 2097 | TGGACCTTTAAGATGC | 26 | 3316 |
| 1129764 | N/A | N/A | 2289 | 2304 | ACATAACCATCGCGAA | 45 | 3317 |
| 1129784 | N/A | N/A | 2499 | 2514 | CGTGTGTTAGACACTT | 42 | 3318 |
| 1129804 | N/A | N/A | 2656 | 2671 | TCTCCTATTGAATGAG | 79 | 3319 |
| 1129824 | N/A | N/A | 3032 | 3047 | GGAGTAGACTCCTGAC | 85 | 3320 |
| 1129844 | N/A | N/A | 3410 | 3425 | CTCAAAAGGTCGCTG | 43 | 3321 |
| 1129864 | N/A | N/A | 3897 | 3912 | TGGTGATACCAGGAGA | 21 | 3322 |
| 1129884 | N/A | N/A | 4066 | 4081 | CCCTTCTTGAACCTAC | 58 | 3323 |
| 1129904 | N/A | N/A | 4332 | 4347 | TGCCAAGTCTCCGAGT | 52 | 3324 |
| 1129924 | N/A | N/A | 4583 | 4598 | TGGCACACCACCCGGC | 51 | 3325 |
| 1129944 | N/A | N/A | 4809 | 4824 | TGGCAAGCCCGTCCCA | 41 | 3326 |
| 1129964 | N/A | N/A | 5149 | 5164 | CCTGTAGCCACACGAC | 61 | 3327 |
| 1129984 | N/A | N/A | 5433 | 5448 | CCGGCTGGCCGGAATC | 63 | 3328 |
| 1130004 | N/A | N/A | 5710 | 5725 | TACTCGCCGGTCCTGC | 34 | 3329 |
| 1130024 | N/A | N/A | 5842 | 5857 | CCCGGGAGCTCCGGAG | 138 | 3330 |
| 1130044 | N/A | N/A | 6161 | 6176 | ACCCGGGCGGAGAGGA | 38 | 3331 |
| 1130064 | N/A | N/A | 6313 | 6328 | CCTACCCTCGAACTGG | 62 | 3332 |
| 1130084 | N/A | N/A | 6380 | 6395 | GCGGGCTTCTTCCGCC | 103 | 3333 |
| 1130104 | N/A | N/A | 6400 | 6415 | CCCGGAACGATACCAA | 75 | 3334 |

TABLE 54-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID No. |
|---|---|---|---|---|---|---|---|
| 1130124 | N/A | N/A | 6527 | 6542 | CGATTCTCCCTGTATC | 34 | 3335 |
| 1130144 | N/A | N/A | 6602 | 6617 | ACTAGCCCGGAGCGCG | 56 | 3336 |
| 1130164 | N/A | N/A | 6667 | 6682 | GGGCGGAGCGGAAACA | 87 | 3337 |
| 1130184 | N/A | N/A | 6781 | 6796 | GTAAACCCACTCATGC | 63 | 3338 |
| 1130204 | N/A | N/A | 6841 | 6856 | TCACACCCCATCTGAC | 52 | 3339 |
| 1130224 | N/A | N/A | 7032 | 7047 | CAACCGGGCTAAGAGC | 74† | 3340 |
| 1130244 | N/A | N/A | 7102 | 7117 | CTGGGTCGGAAACACG | 57† | 3341 |

TABLE 55

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128744 | 98 | 113 | N/A | N/A | GTGGAATCGAAAGTGT | 37 | 3342 |
| 1128764 | 148 | 163 | 515 | 530 | GACTGTGTGCTCTTCA | 12 | 3343 |
| 1128784 | 170 | 185 | 3521 | 3536 | GCTCCCCGGTGACAGT | 44 | 3344 |
| 1128802 | 218 | 233 | 3569 | 3584 | TACATTTGTGGTACAG | 13 | 2426 |
| 1128805 | 221 | 236 | 3572 | 3587 | GGGTACATTTGTGGTA | 35 | 3345 |
| 1128825 | 284 | 299 | 3791 | 3806 | GCTGGTCCTGATCAAA | 31 | 3346 |
| 1128845 | 365 | 380 | 4173 | 4188 | CACAGGTCCCTCCTTT | 41 | 3347 |
| 1128865 | 465 | 480 | 4410 | 4425 | AAAAACCGGAGAAGCT | 57 | 3348 |
| 1128885 | 536 | 551 | 4481 | 4496 | CATCAGGACCCTTGCA | 51 | 3349 |
| 1128905 | 589 | 604 | 4673 | 4688 | ATGGAGGCACGGGTTG | 34 | 3350 |
| 1128925 | 619 | 634 | 4703 | 4718 | GTGGCCCTCCACCTCT | 37 | 3351 |
| 1128945 | 653 | 668 | 4737 | 4752 | CTCCGGTGTAGCCCAC | 51 | 3352 |
| 1128965 | 698 | 713 | 4927 | 4942 | CGCGGCCATCATAGCA | 76 | 3353 |
| 1128985 | 750 | 765 | 4979 | 4994 | TGACAGGGCGCACCCG | 43 | 3354 |
| 1129005 | 781 | 796 | 5010 | 5025 | GTTCCGGTAGGTGGCC | 49 | 3355 |
| 1129025 | 840 | 855 | N/A | N/A | GGGTTCCGGCAGAAGG | 37 | 3356 |
| 1129045 | 882 | 897 | 5196 | 5211 | TCGCGGTTCAGCACGA | 41 | 3357 |
| 1129065 | 973 | 988 | 5287 | 5302 | GACATGAAGCCTAGGG | 17 | 3358 |
| 1129085 | 1006 | 1021 | 5320 | 5335 | CTTCGGCGGTGCCGGC | 41 | 3359 |
| 1129105 | 1071 | 1086 | 5490 | 5505 | TCCCGCTTCGCCGGCA | 35 | 3360 |
| 1129125 | 1117 | 1132 | 5536 | 5551 | CTGCCCGCAGCTCAGT | 36 | 3361 |
| 1129145 | 1142 | 1157 | 5561 | 5576 | TCGAAGACAGACTCTT | 31 | 3362 |

TABLE 55-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129165 | 1168 | 1183 | 5587 | 5602 | CACCAGCCCGCCAACG | 53 | 3363 |
| 1129185 | 1228 | 1243 | 5647 | 5662 | GGCGCAGAAACTGTGG | 42 | 3364 |
| 1129205 | 1304 | 1319 | 5964 | 5979 | TCAGATCCTCGGGTGC | 29 | 3365 |
| 1129225 | 1375 | 1390 | 6035 | 6050 | GTAGGAGCGCACGGCC | 32 | 3366 |
| 1129245 | 1413 | 1428 | 6073 | 6088 | TGCTGGTAGCTGACGG | 36 | 3367 |
| 1129265 | 1454 | 1469 | 6197 | 6212 | TGCCGTCCGCATCCTC | 40 | 3368 |
| 1129285 | 1476 | 1491 | 6219 | 6234 | TAAGGCGACAGGAGCG | 33 | 3369 |
| 1129305 | 1523 | 1538 | 6266 | 6281 | TCTCGGAGGGTCGCGC | 39 | 3370 |
| 1129325 | 1570 | 1585 | N/A | N/A | CGCCCCTCGAACTGG | 131 | 3371 |
| 1129345 | 1611 | 1626 | 6909 | 6924 | AACGGTACCTGCGCCT | 82 | 3372 |
| 1129365 | 1684 | 1699 | 6982 | 6997 | CCCTGCGCAGAGCATG | 21† | 3373 |
| 1129385 | 1708 | 1723 | 7006 | 7021 | CGCATCGGTGCCGCCC | 17† | 3374 |
| 1129405 | 1777 | 1792 | 7165 | 7180 | TTGCAGGGTGAGCGG | 40 | 3375 |
| 1129425 | 1820 | 1835 | 7208 | 7223 | GCTTGTTGCGGTCACC | 27 | 3376 |
| 1129445 | 1851 | 1866 | 7239 | 7254 | AGGTAGTAGGCCACAT | 23 | 3377 |
| 1129465 | 1885 | 1900 | 7273 | 7288 | CAATCAGGAAACGGTG | 29 | 3378 |
| 1129485 | 1921 | 1936 | 7309 | 7324 | GCGGAATCACCAAGGA | 7 | 3379 |
| 1129505 | 1962 | 1977 | 7350 | 7365 | GGACACAATCTTGCCT | 34 | 3380 |
| 1129525 | 2003 | 2018 | 7391 | 7406 | CTGCGCCATCCTGGCG | 65 | 3381 |
| 1129545 | 2024 | 2039 | 7412 | 7427 | TCAAAGCACTTTATTG | 15 | 3382 |
| 1129565 | N/A | N/A | 144 | 159 | ATAGCGACCCCCCAGA | 46 | 3383 |
| 1129585 | N/A | N/A | 273 | 288 | TTGTATCCACCCAGTC | 93 | 3384 |
| 1129605 | N/A | N/A | 420 | 435 | TCATAGCCTGCCACCG | 73 | 3385 |
| 1129625 | N/A | N/A | 554 | 569 | ACCCAAGGGTTCCCGG | 142 | 3386 |
| 1129645 | N/A | N/A | 629 | 644 | GCATAAGACCTAGCAC | 80 | 3387 |
| 1129665 | N/A | N/A | 725 | 740 | AAGCACCTGCTCCGAG | 78 | 3388 |
| 1129685 | N/A | N/A | 1009 | 1024 | CTGTTATCAACCTGGT | 64 | 3389 |
| 1129705 | N/A | N/A | 1204 | 1219 | GGTAATTTAGTGTCTG | 48 | 3390 |
| 1129725 | N/A | N/A | 1594 | 1609 | TGCTTAGAGACTCAAC | 76 | 3391 |
| 1129745 | N/A | N/A | 2084 | 2099 | GATGGACCTTTAAGAT | 72 | 3392 |
| 1129765 | N/A | N/A | 2290 | 2305 | AACATAACCATCGCGA | 55 | 3393 |
| 1129785 | N/A | N/A | 2513 | 2528 | CCTTAGGGAGAAAGCG | 51 | 3394 |
| 1129805 | N/A | N/A | 2659 | 2674 | AGCTCTCCTATTGAAT | 69 | 3395 |
| 1129825 | N/A | N/A | 3034 | 3049 | CTGGAGTAGACTCCTG | 66 | 3396 |
| 1129845 | N/A | N/A | 3411 | 3426 | CCTCAAAAGGTCGCT | 59 | 3397 |

TABLE 55-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129865 | N/A | N/A | 3900 | 3915 | GTCTGGTGATACCAGG | 54 | 3398 |
| 1129885 | N/A | N/A | 4069 | 4084 | AGGCCCTTCTTGAACC | 72 | 3399 |
| 1129905 | N/A | N/A | 4333 | 4348 | ATGCCAAGTCTCCGAG | 68 | 3400 |
| 1129925 | N/A | N/A | 4584 | 4599 | CTGGCACACCACCCGG | 68 | 3401 |
| 1129945 | N/A | N/A | 4810 | 4825 | CTGGCAAGCCCGTCCC | 48 | 3402 |
| 1129965 | N/A | N/A | 5150 | 5165 | TCCTGTAGCCACACGA | 109 | 3403 |
| 1129985 | N/A | N/A | 5434 | 5449 | GCCGGCTGGCCGGAAT | 89 | 3404 |
| 1130005 | N/A | N/A | 5711 | 5726 | GTACTCGCCGGTCCTG | 76 | 3405 |
| 1130025 | N/A | N/A | 5843 | 5858 | CCCCGGGAGCTCCGGA | 77 | 3406 |
| 1130045 | N/A | N/A | 6162 | 6177 | AACCCGGGCGGAGAGG | 96 | 3407 |
| 1130065 | N/A | N/A | 6314 | 6329 | GCCTACCCTCGAACTG | 85 | 3408 |
| 1130085 | N/A | N/A | 6381 | 6396 | CGCGGGCTTCTTCCGC | 88 | 3409 |
| 1130105 | N/A | N/A | 6401 | 6416 | ACCCGGAACGATACCA | 69 | 3410 |
| 1130125 | N/A | N/A | 6529 | 6544 | TTCGATTCTCCCTGTA | 77 | 3411 |
| 1130145 | N/A | N/A | 6603 | 6618 | CACTAGCCCGGAGCGC | 80 | 3412 |
| 1130165 | N/A | N/A | 6668 | 6683 | TGGGCGGAGCGGAAAC | 80 | 3413 |
| 1130185 | N/A | N/A | 6783 | 6798 | TTGTAAACCCACTCAT | 82 | 3414 |
| 1130205 | N/A | N/A | 6862 | 6877 | TGCGAACACAGAGCGC | 113 | 3415 |
| 1130225 | N/A | N/A | 7033 | 7048 | CCAACCGGGCTAAGAG | 65† | 3416 |
| 1130245 | N/A | N/A | 7103 | 7118 | CCTGGGTCGGAAACAC | 80† | 3417 |

TABLE 56

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128745 | 99 | 114 | N/A | N/A | GGTGGAATCGAAAGTG | 45 | 3418 |
| 1128765 | 149 | 164 | 516 | 531 | CGACTGTGTGCTCTTC | 13 | 3419 |
| 1128785 | 171 | 186 | 3522 | 3537 | GGCTCCCCGGTGACAG | 37 | 3420 |
| 1128802 | 218 | 233 | 3569 | 3584 | TACATTTGTGGTACAG | 14 | 2426 |
| 1128806 | 222 | 237 | 3573 | 3588 | TGGGTACATTTGTGGT | 33 | 3421 |
| 1128826 | 285 | 300 | 3792 | 3807 | CGCTGGTCCTGATCAA | 23 | 3422 |
| 1128846 | 366 | 381 | 4174 | 4189 | ACACAGGTCCCTCCTT | 48 | 3423 |
| 1128866 | 466 | 481 | 4411 | 4426 | GAAAACCGGAGAAGC | 46 | 3424 |
| 1128886 | 537 | 552 | 4482 | 4497 | GCATCAGGACCCTTGC | 67 | 3425 |

TABLE 56-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128906 | 590 | 605 | 4674 | 4689 | CATGGAGGCACGGGTT | 29 | 3426 |
| 1128926 | 623 | 638 | 4707 | 4722 | GGCGGTGGCCCTCCAC | 38 | 3427 |
| 1128946 | 654 | 669 | 4738 | 4753 | GCTCCGGTGTAGCCCA | 69 | 3428 |
| 1128966 | 699 | 714 | 4928 | 4943 | CCGCGGCCATCATAGC | 77 | 3429 |
| 1128986 | 751 | 766 | 4980 | 4995 | CTGACAGGGCGCACCC | 38 | 3430 |
| 1129006 | 799 | 814 | 5028 | 5043 | CGCTTGCTCGGCAGTC | 23 | 3431 |
| 1129026 | 841 | 856 | N/A | N/A | CGGGTTCCGGCAGAAG | 40 | 3432 |
| 1129046 | 883 | 898 | 5197 | 5212 | GTCGCGGTTCAGCACG | 24 | 3433 |
| 1129066 | 974 | 989 | 5288 | 5303 | GGACATGAAGCCTAGG | 23 | 3434 |
| 1129086 | 1007 | 1022 | 5321 | 5336 | GCTTCGGCGGTGCCGG | 33 | 3435 |
| 1129106 | 1073 | 1088 | 5492 | 5507 | GCTCCCGCTTCGCCGG | 52 | 3436 |
| 1129126 | 1119 | 1134 | 5538 | 5553 | CGCTGCCCGCAGCTCA | 31 | 3437 |
| 1129146 | 1143 | 1158 | 5562 | 5577 | ATCGAAGACAGACTCT | 25 | 3438 |
| 1129166 | 1171 | 1186 | 5590 | 5605 | CGCCACCAGCCCGCCA | 45 | 3439 |
| 1129186 | 1229 | 1244 | 5648 | 5663 | CGGCGCAGAAACTGTG | 36 | 3440 |
| 1129206 | 1306 | 1321 | 5966 | 5981 | CGTCAGATCCTCGGGT | 30 | 3441 |
| 1129226 | 1377 | 1392 | 6037 | 6052 | CGGTAGGAGCGCACGG | 25 | 3442 |
| 1129246 | 1429 | 1444 | N/A | N/A | CAACAGAGCCAGGTCG | 36 | 3443 |
| 1129266 | 1455 | 1470 | 6198 | 6213 | CTGCCGTCCGCATCCT | 42 | 3444 |
| 1129286 | 1477 | 1492 | 6220 | 6235 | GTAAGGCGACAGGAGC | 23 | 3445 |
| 1129306 | 1524 | 1539 | 6267 | 6282 | GTCTCGGAGGGTCGCG | 33 | 3446 |
| 1129326 | 1571 | 1586 | N/A | N/A | CCGCCCCTCGAACTG | 69 | 3447 |
| 1129346 | 1612 | 1627 | 6910 | 6925 | GAACGGTACCTGCGCC | 96 | 3448 |
| 1129366 | 1685 | 1700 | 6983 | 6998 | ACCCTGCGCAGAGCAT | 19† | 3449 |
| 1129386 | 1709 | 1724 | 7007 | 7022 | ACGCATCGGTGCCGCC | 17† | 3450 |
| 1129406 | 1780 | 1795 | 7168 | 7183 | GCCTTGCAGGGTGAGC | 25 | 3451 |
| 1129426 | 1821 | 1836 | 7209 | 7224 | GGCTTGTTGCGGTCAC | 16 | 3452 |
| 1129446 | 1852 | 1867 | 7240 | 7255 | CAGGTAGTAGGCCACA | 25 | 3453 |
| 1129466 | 1888 | 1903 | 7276 | 7291 | GAGCAATCAGGAAACG | 20 | 3454 |
| 1129486 | 1922 | 1937 | 7310 | 7325 | TGCGGAATCACCAAGG | 9 | 3455 |
| 1129506 | 1964 | 1979 | 7352 | 7367 | TGGGACACAATCTTGC | 25 | 3456 |
| 1129526 | 2004 | 2019 | 7392 | 7407 | CCTGCGCCATCCTGGC | 21 | 3457 |
| 1129546 | 2031 | 2046 | 7419 | 7434 | AGCATTTTCAAAGCAC | 51 | 3458 |
| 1129566 | N/A | N/A | 145 | 160 | GATAGCGACCCCCCAG | 53 | 3459 |
| 1129586 | N/A | N/A | 277 | 292 | GCCCTTGTATCCACCC | 80 | 3460 |

TABLE 56-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
| --- | --- | --- | --- | --- | --- | --- | --- |
| 1129606 | N/A | N/A | 422 | 437 | AGTCATAGCCTGCCAC | 110 | 3461 |
| 1129626 | N/A | N/A | 555 | 570 | CACCCAAGGGTTCCCG | 81 | 3462 |
| 1129646 | N/A | N/A | 630 | 645 | GGCATAAGACCTAGCA | 73 | 3463 |
| 1129666 | N/A | N/A | 727 | 742 | TCAAGCACCTGCTCCG | 53 | 3464 |
| 1129686 | N/A | N/A | 1010 | 1025 | ACTGTTATCAACCTGG | 54 | 3465 |
| 1129706 | N/A | N/A | 1206 | 1221 | TAGGTAATTTAGTGTC | 55 | 3466 |
| 1129726 | N/A | N/A | 1596 | 1611 | CATGCTTAGAGACTCA | 51 | 3467 |
| 1129746 | N/A | N/A | 2092 | 2107 | GGATCTGAGATGGACC | 43 | 3468 |
| 1129766 | N/A | N/A | 2291 | 2306 | GAACATAACCATCGCG | 60 | 3469 |
| 1129786 | N/A | N/A | 2519 | 2534 | AGGCTACCTTAGGGAG | 64 | 3470 |
| 1129806 | N/A | N/A | 2683 | 2698 | CGTCACGCTGCTGCTG | 45 | 3471 |
| 1129826 | N/A | N/A | 3035 | 3050 | GCTGGAGTAGACTCCT | 54 | 3472 |
| 1129846 | N/A | N/A | 3412 | 3427 | CCCTCAAAAAGGTCGC | 71 | 3473 |
| 1129866 | N/A | N/A | 3956 | 3971 | CAAAGGGTATTGTGGA | 48 | 3474 |
| 1129886 | N/A | N/A | 4306 | 4321 | CTATTCTGTAGGCCCA | 62 | 3475 |
| 1129906 | N/A | N/A | 4343 | 4358 | GTCTAGGACCATGCCA | 95 | 3476 |
| 1129926 | N/A | N/A | 4607 | 4622 | ACCCCCCCAGAGAGCT | 91 | 3477 |
| 1129946 | N/A | N/A | 4812 | 4827 | TCCTGGCAAGCCCGTC | 37 | 3478 |
| 1129966 | N/A | N/A | 5157 | 5172 | TCCGGGTTCCTGTAGC | 60 | 3479 |
| 1129986 | N/A | N/A | 5436 | 5451 | CGGCCGGCTGGCCGGA | 84 | 3480 |
| 1130006 | N/A | N/A | 5712 | 5727 | GGTACTCGCCGGTCCT | 50 | 3481 |
| 1130026 | N/A | N/A | 5844 | 5859 | TCCCCGGGAGCTCCGG | 102 | 3482 |
| 1130046 | N/A | N/A | 6163 | 6178 | TAACCCGGGCGGAGAG | 88 | 3483 |
| 1130066 | N/A | N/A | 6315 | 6330 | TGCCTACCCTCGAACT | 100 | 3484 |
| 1130086 | N/A | N/A | 6382 | 6397 | TCGCGGGCTTCTTCCG | 56 | 3485 |
| 1130106 | N/A | N/A | 6402 | 6417 | CACCCGGAACGATACC | 67 | 3486 |
| 1130126 | N/A | N/A | 6531 | 6546 | AGTTCGATTCTCCCTG | 57 | 3487 |
| 1130146 | N/A | N/A | 6604 | 6619 | ACACTAGCCCGGAGCG | 66 | 3488 |
| 1130166 | N/A | N/A | 6669 | 6684 | ATGGGCGGAGCGGAAA | 108 | 3489 |
| 1130186 | N/A | N/A | 6784 | 6799 | CTTGTAAACCCACTCA | 57 | 3490 |
| 1130206 | N/A | N/A | 6863 | 6878 | CTGCGAACACAGAGCG | 100 | 3491 |
| 1130226 | N/A | N/A | 7034 | 7049 | GCCAACCGGGCTAAGA | 134† | 3492 |
| 1130246 | N/A | N/A | 7104 | 7119 | CCCTGGGTCGGAAACA | 87† | 3493 |

TABLE 57

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128746 | 101 | 116 | N/A | N/A | AAGGTGGAATCGAAAG | 68 | 3494 |
| 1128766 | 150 | 165 | N/A | N/A | ACGACTGTGTGCTCTT | 20 | 3495 |
| 1128786 | 175 | 190 | 3526 | 3541 | GCAGGGCTCCCCGGTG | 45 | 3496 |
| 1128802 | 218 | 233 | 3569 | 3584 | TACATTTGTGGTACAG | 38 | 2426 |
| 1128807 | 223 | 238 | 3574 | 3589 | GTGGGTACATTTGTGG | 57 | 3497 |
| 1128827 | 287 | 302 | 3794 | 3809 | ATCGCTGGTCCTGATC | 57 | 3498 |
| 1128847 | 370 | 385 | 4178 | 4193 | GTTCACACAGGTCCCT | 40 | 3499 |
| 1128867 | 467 | 482 | 4412 | 4427 | GGAAAAACCGGAGAAG | 63 | 3500 |
| 1128887 | 538 | 553 | 4483 | 4498 | GGCATCAGGACCCTTG | 58 | 3501 |
| 1128907 | 591 | 606 | 4675 | 4690 | CCATGGAGGCACGGGT | 50 | 3502 |
| 1128927 | 624 | 639 | 4708 | 4723 | AGGCGGTGGCCCTCCA | 69 | 3503 |
| 1128947 | 655 | 670 | 4739 | 4754 | GGCTCCGGTGTAGCCC | 97 | 3504 |
| 1128967 | 700 | 715 | 4929 | 4944 | CCCGCGGCCATCATAG | 100 | 3505 |
| 1128987 | 752 | 767 | 4981 | 4996 | GCTGACAGGGCGCACC | 48 | 3506 |
| 1129007 | 801 | 816 | 5030 | 5045 | CGCGCTTGCTCGGCAG | 71 | 3507 |
| 1129027 | 842 | 857 | N/A | N/A | CCGGGTTCCGGCAGAA | 51 | 3508 |
| 1129047 | 884 | 899 | 5198 | 5213 | GGTCGCGGTTCAGCAC | 44 | 3509 |
| 1129067 | 976 | 991 | 5290 | 5305 | TGGGACATGAAGCCTA | 61 | 3510 |
| 1129087 | 1008 | 1023 | 5322 | 5337 | GGCTTCGGCGGTGCCG | 79 | 3511 |
| 1129107 | 1079 | 1094 | 5498 | 5513 | GCGGCTGCTCCCGCTT | 75 | 3512 |
| 1129127 | 1121 | 1136 | 5540 | 5555 | GCCGCTGCCCGCAGCT | 59 | 3513 |
| 1129147 | 1144 | 1159 | 5563 | 5578 | CATCGAAGACAGACTC | 45 | 3514 |
| 1129167 | 1202 | 1217 | 5621 | 5636 | GCGCGGCGATGTAGGG | 57 | 3515 |
| 1129187 | 1230 | 1245 | 5649 | 5664 | CCGGCGCAGAAACTGT | 73 | 3516 |
| 1129207 | 1309 | 1324 | 5969 | 5984 | CACCGTCAGATCCTCG | 52 | 3517 |
| 1129227 | 1378 | 1393 | 6038 | 6053 | GCGGTAGGAGCGCACG | 41 | 3518 |
| 1129247 | 1431 | 1446 | N/A | N/A | CGCAACAGAGCCAGGT | 48 | 3519 |
| 1129267 | 1456 | 1471 | 6199 | 6214 | GCTGCCGTCCGCATCC | 61 | 3520 |
| 1129287 | 1478 | 1493 | 6221 | 6236 | CGTAAGGCGACAGGAG | 36 | 3521 |
| 1129307 | 1525 | 1540 | 6268 | 6283 | GGTCTCGGAGGGTCGC | 69 | 3522 |
| 1129327 | 1572 | 1587 | N/A | N/A | TCCGCCCCCTCGAACT | 128 | 3523 |
| 1129347 | 1613 | 1628 | 6911 | 6926 | GGAACGGTACCTGCGC | 181 | 3524 |
| 1129367 | 1686 | 1701 | 6984 | 6999 | AACCCTGCGCAGAGCA | 17† | 3525 |
| 1129387 | 1710 | 1725 | 7008 | 7023 | CACGCATCGGTGCCGC | 30† | 3526 |
| 1129407 | 1781 | 1796 | 7169 | 7184 | TGCCTTGCAGGGTGAG | 23 | 3527 |
| 1129427 | 1822 | 1837 | 7210 | 7225 | TGGCTTGTTGCGGTCA | 59 | 3528 |

TABLE 57-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
| --- | --- | --- | --- | --- | --- | --- | --- |
| 1129447 | 1853 | 1868 | 7241 | 7256 | CCAGGTAGTAGGCCAC | 56 | 3529 |
| 1129467 | 1892 | 1907 | 7280 | 7295 | CCCTGAGCAATCAGGA | 48 | 3530 |
| 1129487 | 1923 | 1938 | 7311 | 7326 | CTGCGGAATCACCAAG | 30 | 3531 |
| 1129507 | 1965 | 1980 | 7353 | 7368 | ATGGGACACAATCTTG | 70 | 3532 |
| 1129527 | 2005 | 2020 | 7393 | 7408 | TCCTGCGCCATCCTGG | 33 | 3533 |
| 1129547 | 2033 | 2048 | 7421 | 7436 | TCAGCATTTTCAAAGC | 40 | 3534 |
| 1129567 | N/A | N/A | 146 | 161 | TGATAGCGACCCCCCA | 67 | 3535 |
| 1129587 | N/A | N/A | 279 | 294 | GTGCCCTTGTATCCAC | 76 | 3536 |
| 1129607 | N/A | N/A | 423 | 438 | AAGTCATAGCCTGCCA | 115 | 3537 |
| 1129627 | N/A | N/A | 571 | 586 | GCACCATACACATCCC | 57 | 3538 |
| 1129647 | N/A | N/A | 631 | 646 | GGGCATAAGACCTAGC | 76 | 3539 |
| 1129667 | N/A | N/A | 736 | 751 | GCACATATCTCAAGCA | 53 | 3540 |
| 1129687 | N/A | N/A | 1017 | 1032 | GAGGTTTACTGTTATC | 78 | 3541 |
| 1129707 | N/A | N/A | 1207 | 1222 | GTAGGTAATTTAGTGT | 73 | 3542 |
| 1129727 | N/A | N/A | 1599 | 1614 | CGCCATGCTTAGAGAC | 82 | 3543 |
| 1129747 | N/A | N/A | 2132 | 2147 | TGCCAAGGACCAAACC | 72 | 3544 |
| 1129767 | N/A | N/A | 2292 | 2307 | AGAACATAACCATCGC | 63 | 3545 |
| 1129787 | N/A | N/A | 2520 | 2535 | AAGGCTACCTTAGGGA | 94 | 3546 |
| 1129807 | N/A | N/A | 2697 | 2712 | AAGGTTCAACAAGGCG | 61 | 3547 |
| 1129827 | N/A | N/A | 3036 | 3051 | AGCTGGAGTAGACTCC | 75 | 3548 |
| 1129847 | N/A | N/A | 3469 | 3484 | CCCTGTACTCAACTGC | 65 | 3549 |
| 1129867 | N/A | N/A | 3957 | 3972 | CCAAAGGGTATTGTGG | 74 | 3550 |
| 1129887 | N/A | N/A | 4308 | 4323 | ACCTATTCTGTAGGCC | 88 | 3551 |
| 1129907 | N/A | N/A | 4344 | 4359 | AGTCTAGGACCATGCC | 100 | 3552 |
| 1129927 | N/A | N/A | 4611 | 4626 | AAAGACCCCCCCAGAG | 116 | 3553 |
| 1129947 | N/A | N/A | 4837 | 4852 | TGCTTTCCGCACTCTC | 54 | 3554 |
| 1129967 | N/A | N/A | 5158 | 5173 | GTCCGGGTTCCTGTAG | 85 | 3555 |
| 1129987 | N/A | N/A | 5438 | 5453 | CGCGGCCGGCTGGCCG | 89 | 3556 |
| 1130007 | N/A | N/A | 5713 | 5728 | GGGTACTCGCCGGTCC | 62 | 3557 |
| 1130027 | N/A | N/A | 5862 | 5877 | TCCCGTGTTCCAGCTT | 80 | 3558 |
| 1130047 | N/A | N/A | 6164 | 6179 | CTAACCCGGGCGGAGA | 80 | 3559 |
| 1130067 | N/A | N/A | 6316 | 6331 | GTGCCTACCCTCGAAC | 112 | 3560 |
| 1130087 | N/A | N/A | 6383 | 6398 | GTCGCGGGCTTCTTCC | 54 | 3561 |
| 1130107 | N/A | N/A | 6403 | 6418 | GCACCCGGAACGATAC | 80 | 3562 |
| 1130127 | N/A | N/A | 6532 | 6547 | AAGTTCGATTCTCCCT | 70 | 3563 |

TABLE 57-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130147 | N/A | N/A | 6605 | 6620 | CACACTAGCCCGGAGC | 86 | 3564 |
| 1130167 | N/A | N/A | 6670 | 6685 | AATGGGCGGAGCGGAA | 79 | 3565 |
| 1130187 | N/A | N/A | 6785 | 6800 | GCTTGTAAACCCACTC | 73 | 3566 |
| 1130207 | N/A | N/A | 6865 | 6880 | CCCTGCGAACACAGAG | 91 | 3567 |
| 1130227 | N/A | N/A | 7035 | 7050 | CGCCAACCGGGCTAAG | 98† | 3568 |
| 1130247 | N/A | N/A | 7105 | 7120 | ACCCTGGGTCGGAAAC | 96† | 3569 |

TABLE 58

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128747 | 102 | 117 | N/A | N/A | CAAGGTGGAATCGAAA | 21 | 3570 |
| 1128767 | 151 | 166 | N/A | N/A | AACGACTGTGTGCTCT | 43 | 3571 |
| 1128787 | 176 | 191 | 3527 | 3542 | GGCAGGGCTCCCCGGT | 45 | 3572 |
| 1128802 | 218 | 233 | 3569 | 3584 | TACATTTGTGGTACAG | 20 | 2426 |
| 1128808 | 224 | 239 | 3575 | 3590 | TGTGGGTACATTTGTG | 30 | 3573 |
| 1128828 | 288 | 303 | 3795 | 3810 | CATCGCTGGTCCTGAT | 46 | 3574 |
| 1128848 | 373 | 388 | 4181 | 4196 | CATGTTCACACAGGTC | 31 | 3575 |
| 1128868 | 468 | 483 | 4413 | 4428 | TGGAAAACCGGAGAA | 47 | 3576 |
| 1128888 | 539 | 554 | 4484 | 4499 | GGGCATCAGGACCCTT | 69 | 3577 |
| 1128908 | 592 | 607 | 4676 | 4691 | CCCATGGAGGCACGGG | 76 | 3578 |
| 1128928 | 625 | 640 | 4709 | 4724 | CAGGCGGTGGCCCTCC | 44 | 3579 |
| 1128948 | 657 | 672 | 4741 | 4756 | AAGGCTCCGGTGTAGC | 73 | 3580 |
| 1128968 | 701 | 716 | 4930 | 4945 | GCCCGCGGCCATCATA | 52 | 3581 |
| 1128988 | 753 | 768 | 4982 | 4997 | GGCTGACAGGGCGCAC | 40 | 3582 |
| 1129008 | 802 | 817 | 5031 | 5046 | CCGCGCTTGCTCGGCA | 35 | 3583 |
| 1129028 | 843 | 858 | N/A | N/A | TCCGGGTTCCGGCAGA | 35 | 3584 |
| 1129048 | 885 | 900 | 5199 | 5214 | CGGTCGCGGTTCAGCA | 39 | 3585 |
| 1129068 | 977 | 992 | 5291 | 5306 | GTGGGACATGAAGCCT | 31 | 3586 |
| 1129088 | 1009 | 1024 | 5323 | 5338 | AGGCTTCGGCGGTGCC | 78 | 3587 |
| 1129108 | 1082 | 1097 | 5501 | 5516 | AAGGCGGCTGCTCCCG | 46 | 3588 |
| 1129128 | 1124 | 1139 | 5543 | 5558 | GGAGCCGCTGCCCGCA | 40 | 3589 |
| 1129148 | 1145 | 1160 | 5564 | 5579 | TCATCGAAGACAGACT | 36 | 3590 |
| 1129168 | 1203 | 1218 | 5622 | 5637 | AGCGCGGCGATGTAGG | 54 | 3591 |

TABLE 58-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129188 | 1231 | 1246 | 5650 | 5665 | GCCGGCGCAGAAACTG | 81 | 3592 |
| 1129208 | 1311 | 1326 | 5971 | 5986 | ACCACCGTCAGATCCT | 48 | 3593 |
| 1129228 | 1379 | 1394 | 6039 | 6054 | AGCGGTAGGAGCGCAC | 48 | 3594 |
| 1129248 | 1433 | 1448 | N/A | N/A | GGCGCAACAGAGCCAG | 63 | 3595 |
| 1129268 | 1457 | 1472 | 6200 | 6215 | AGCTGCCGTCCGCATC | 42 | 3596 |
| 1129288 | 1492 | 1507 | 6235 | 6250 | GCACACCGGCTGAACG | 52 | 3597 |
| 1129308 | 1542 | 1557 | 6285 | 6300 | GCCACCTGGCAGAGCG | 73 | 3598 |
| 1129328 | 1573 | 1588 | N/A | N/A | CTCCGCCCCTCGAAC | 135 | 3599 |
| 1129348 | 1614 | 1629 | 6912 | 6927 | AGGAACGGTACCTGCG | 127 | 3600 |
| 1129368 | 1688 | 1703 | 6986 | 7001 | GGAACCCTGCGCAGAG | 7† | 3601 |
| 1129388 | 1711 | 1726 | 7009 | 7024 | GCACGCATCGGTGCCG | 84† | 3602 |
| 1129408 | 1785 | 1800 | 7173 | 7188 | ATGATGCCTTGCAGGG | 16 | 3603 |
| 1129428 | 1823 | 1838 | 7211 | 7226 | CTGGCTTGTTGCGGTC | 48 | 3604 |
| 1129448 | 1854 | 1869 | 7242 | 7257 | GCCAGGTAGTAGGCCA | 64 | 3605 |
| 1129468 | 1893 | 1908 | 7281 | 7296 | TCCCTGAGCAATCAGG | 45 | 3606 |
| 1129488 | 1924 | 1939 | 7312 | 7327 | ACTGCGGAATCACCAA | 20 | 3607 |
| 1129508 | 1967 | 1982 | 7355 | 7370 | GAATGGGACACAATCT | 63 | 3608 |
| 1129528 | 2006 | 2021 | 7394 | 7409 | TTCCTGCGCCATCCTG | 35 | 3609 |
| 1129548 | N/A | N/A | 92 | 107 | CCGAAAGTGTTGACTC | 44 | 3610 |
| 1129568 | N/A | N/A | 147 | 162 | GTGATAGCGACCCCCC | 58 | 3611 |
| 1129588 | N/A | N/A | 323 | 338 | CCCCGTTGTCTTCTTA | 80 | 3612 |
| 1129608 | N/A | N/A | 425 | 440 | ATAAGTCATAGCCTGC | 93 | 3613 |
| 1129628 | N/A | N/A | 598 | 613 | CTAGACTGCCCTGAGA | 55 | 3614 |
| 1129648 | N/A | N/A | 636 | 651 | CCCATGGGCATAAGAC | 89 | 3615 |
| 1129668 | N/A | N/A | 737 | 752 | AGCACATATCTCAAGC | 75 | 3616 |
| 1129688 | N/A | N/A | 1022 | 1037 | CCTAAGAGGTTTACTG | 78 | 3617 |
| 1129708 | N/A | N/A | 1208 | 1223 | TGTAGGTAATTTAGTG | 67 | 3618 |
| 1129728 | N/A | N/A | 1695 | 1710 | CAAGTTTGGGTAAGGC | 57 | 3619 |
| 1129748 | N/A | N/A | 2137 | 2152 | GCACTTGCCAAGGACC | 42 | 3620 |
| 1129768 | N/A | N/A | 2293 | 2308 | TAGAACATAACCATCG | 59 | 3621 |
| 1129788 | N/A | N/A | 2521 | 2536 | GAAGGCTACCTTAGGG | 61 | 3622 |
| 1129808 | N/A | N/A | 2700 | 2715 | GTTAAGGTTCAACAAG | 59 | 3623 |
| 1129828 | N/A | N/A | 3037 | 3052 | TAGCTGGAGTAGACTC | 62 | 3624 |
| 1129848 | N/A | N/A | 3476 | 3491 | GGACTTCCCCTGTACT | 70 | 3625 |
| 1129868 | N/A | N/A | 3958 | 3973 | TCCAAAGGGTATTGTG | 64 | 3626 |

TABLE 58-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129888 | N/A | N/A | 4309 | 4324 | AACCTATTCTGTAGGC | 74 | 3627 |
| 1129908 | N/A | N/A | 4345 | 4360 | GAGTCTAGGACCATGC | 85 | 3628 |
| 1129928 | N/A | N/A | 4613 | 4628 | CTAAAGACCCCCCAG | 77 | 3629 |
| 1129948 | N/A | N/A | 4840 | 4855 | ATCTGCTTTCCGCACT | 23 | 3630 |
| 1129968 | N/A | N/A | 5159 | 5174 | TGTCCGGGTTCCTGTA | 59 | 3631 |
| 1129988 | N/A | N/A | 5440 | 5455 | CCCGCGGCCGGCTGGC | 91 | 3632 |
| 1130008 | N/A | N/A | 5715 | 5730 | GCGGGTACTCGCCGGT | 66 | 3633 |
| 1130028 | N/A | N/A | 5864 | 5879 | AATCCCGTGTTCCAGC | 62 | 3634 |
| 1130048 | N/A | N/A | 6165 | 6180 | GCTAACCCGGGCGGAG | 97 | 3635 |
| 1130068 | N/A | N/A | 6322 | 6337 | GCAGTTGTGCCTACCC | 53 | 3636 |
| 1130088 | N/A | N/A | 6384 | 6399 | AGTCGCGGGCTTCTTC | 78 | 3637 |
| 1130108 | N/A | N/A | 6405 | 6420 | AGGCACCCGGAACGAT | 62 | 3638 |
| 1130128 | N/A | N/A | 6533 | 6548 | CAAGTTCGATTCTCCC | 58 | 3639 |
| 1130148 | N/A | N/A | 6606 | 6621 | CCACACTAGCCCGGAG | 81 | 3640 |
| 1130168 | N/A | N/A | 6671 | 6686 | GAATGGGCGGAGCGGA | 86 | 3641 |
| 1130188 | N/A | N/A | 6786 | 6801 | CGCTTGTAAACCCACT | 58 | 3642 |
| 1130208 | N/A | N/A | 6866 | 6881 | CCCCTGCGAACACAGA | 111 | 3643 |
| 1130228 | N/A | N/A | 7036 | 7051 | GCGCCAACCGGGCTAA | 78† | 3644 |
| 1130248 | N/A | N/A | 7106 | 7121 | CACCCTGGGTCGGAAA | 67† | 3645 |

TABLE 59

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128748 | 103 | 118 | N/A | N/A | CCAAGGTGGAATCGAA | 49 | 3646 |
| 1128768 | 152 | 167 | N/A | N/A | GAACGACTGTGTGCTC | 29 | 3647 |
| 1128788 | 177 | 192 | 3528 | 3543 | TGGCAGGGCTCCCCGG | 55 | 3648 |
| 1128802 | 218 | 233 | 3569 | 3584 | TACATTTGTGGTACAG | 35 | 2426 |
| 1128809 | 225 | 240 | 3576 | 3591 | TTGTGGGTACATTTGT | 51 | 3649 |
| 1128829 | 290 | 305 | 3797 | 3812 | CCCATCGCTGGTCCTG | 49 | 3650 |
| 1128849 | 380 | 395 | 4188 | 4203 | CGCTTGGCATGTTCAC | 41 | 3651 |
| 1128869 | 469 | 484 | 4414 | 4429 | GTGGAAAAACCGGAGA | 58 | 3652 |
| 1128889 | 540 | 555 | 4485 | 4500 | TGGGCATCAGGACCCT | 79 | 3653 |
| 1128909 | 593 | 608 | 4677 | 4692 | CCCCATGGAGGCACGG | 52 | 3654 |

TABLE 59-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128929 | 626 | 641 | 4710 | 4725 | ACAGGCGGTGGCCCTC | 48 | 3655 |
| 1128949 | 660 | 675 | 4744 | 4759 | CAGAAGGCTCCGGTGT | 79 | 3656 |
| 1128969 | 703 | 718 | 4932 | 4947 | GAGCCCGCGGCCATCA | 68 | 3657 |
| 1128989 | 754 | 769 | 4983 | 4998 | CGGCTGACAGGGCGCA | 56 | 3658 |
| 1129009 | 803 | 818 | 5032 | 5047 | TCCGCGCTTGCTCGGC | 57 | 3659 |
| 1129029 | 844 | 859 | N/A | N/A | GTCCGGGTTCCGGCAG | 51 | 3660 |
| 1129049 | 886 | 901 | 5200 | 5215 | CCGGTCGCGGTTCAGC | 55 | 3661 |
| 1129069 | 978 | 993 | 5292 | 5307 | AGTGGGACATGAAGCC | 41 | 3662 |
| 1129089 | 1010 | 1025 | 5324 | 5339 | GAGGCTTCGGCGGTGC | 59 | 3663 |
| 1129109 | 1083 | 1098 | 5502 | 5517 | GAAGGCGGCTGCTCCC | 54 | 3664 |
| 1129129 | 1125 | 1140 | 5544 | 5559 | CGGAGCCGCTGCCCGC | 70 | 3665 |
| 1129149 | 1146 | 1161 | 5565 | 5580 | GTCATCGAAGACAGAC | 58 | 3666 |
| 1129169 | 1204 | 1219 | 5623 | 5638 | CAGCGCGGCGATGTAG | 61 | 3667 |
| 1129189 | 1233 | 1248 | 5652 | 5667 | CTGCCGGCGCAGAAAC | 65 | 3668 |
| 1129209 | 1312 | 1327 | 5972 | 5987 | CACCACCGTCAGATCC | 64 | 3669 |
| 1129229 | 1380 | 1395 | 6040 | 6055 | AAGCGGTAGGAGCGCA | 66 | 3670 |
| 1129249 | 1434 | 1449 | N/A | N/A | AGGCGCAACAGAGCCA | 74 | 3671 |
| 1129269 | 1458 | 1473 | 6201 | 6216 | CAGCTGCCGTCCGCAT | 55 | 3672 |
| 1129289 | 1493 | 1508 | 6236 | 6251 | GGCACACCGGCTGAAC | 56 | 3673 |
| 1129309 | 1545 | 1560 | 6288 | 6303 | CCGGCCACCTGGCAGA | 120 | 3674 |
| 1129329 | 1575 | 1590 | N/A | N/A | TCCTCCGCCCCCTCGA | 145 | 3675 |
| 1129349 | 1615 | 1630 | 6913 | 6928 | GAGGAACGGTACCTGC | 95 | 3676 |
| 1129369 | 1689 | 1704 | 6987 | 7002 | AGGAACCCTGCGCAGA | 20† | 3677 |
| 1129389 | 1713 | 1728 | 7011 | 7026 | TGGCACGCATCGGTGC | 65† | 3678 |
| 1129409 | 1788 | 1803 | 7176 | 7191 | CTGATGATGCCTTGCA | 37 | 3679 |
| 1129429 | 1824 | 1839 | 7212 | 7227 | CCTGGCTTGTTGCGGT | 52 | 3680 |
| 1129449 | 1855 | 1870 | 7243 | 7258 | GGCCAGGTAGTAGGCC | 88 | 3681 |
| 1129469 | 1894 | 1909 | 7282 | 7297 | GTCCCTGAGCAATCAG | 40 | 3682 |
| 1129489 | 1925 | 1940 | 7313 | 7328 | CACTGCGGAATCACCA | 29 | 3683 |
| 1129509 | 1968 | 1983 | 7356 | 7371 | GGAATGGGACACAATC | 45 | 3684 |
| 1129529 | 2007 | 2022 | 7395 | 7410 | GTTCCTGCGCCATCCT | 37 | 3685 |
| 1129549 | N/A | N/A | 93 | 108 | ACCGAAAGTGTTGACT | 63 | 3686 |
| 1129569 | N/A | N/A | 148 | 163 | TGTGATAGCGACCCCC | 74 | 3687 |
| 1129589 | N/A | N/A | 324 | 339 | CCCCCGTTGTCTTCTT | 117 | 3688 |
| 1129609 | N/A | N/A | 426 | 441 | TATAAGTCATAGCCTG | 66 | 3689 |

TABLE 59-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129629 | N/A | N/A | 600 | 615 | GACTAGACTGCCCTGA | 84 | 3690 |
| 1129649 | N/A | N/A | 637 | 652 | GCCCATGGGCATAAGA | 83 | 3691 |
| 1129669 | N/A | N/A | 744 | 759 | CGCCAGCAGCACATAT | 78 | 3692 |
| 1129689 | N/A | N/A | 1023 | 1038 | CCCTAAGAGGTTTACT | 98 | 3693 |
| 1129709 | N/A | N/A | 1214 | 1229 | CTGGCATGTAGGTAAT | 75 | 3694 |
| 1129729 | N/A | N/A | 1696 | 1711 | CCAAGTTTGGGTAAGG | 80 | 3695 |
| 1129749 | N/A | N/A | 2139 | 2154 | GTGCACTTGCCAAGGA | 80 | 3696 |
| 1129769 | N/A | N/A | 2321 | 2336 | TGCTAGTTCAATGTTC | 51 | 3697 |
| 1129789 | N/A | N/A | 2523 | 2538 | AAGAAGGCTACCTTAG | 88 | 3698 |
| 1129809 | N/A | N/A | 2703 | 2718 | CCAGTTAAGGTTCAAC | 64 | 3699 |
| 1129829 | N/A | N/A | 3038 | 3053 | ATAGCTGGAGTAGACT | 80 | 3700 |
| 1129849 | N/A | N/A | 3495 | 3510 | GGGACAACACACTCTC | 68 | 3701 |
| 1129869 | N/A | N/A | 3963 | 3978 | GGACTTCCAAAGGGTA | 66 | 3702 |
| 1129889 | N/A | N/A | 4310 | 4325 | CAACCTATTCTGTAGG | 65 | 3703 |
| 1129909 | N/A | N/A | 4347 | 4362 | GAGAGTCTAGGACCAT | 106 | 3704 |
| 1129929 | N/A | N/A | 4615 | 4630 | GCCTAAAGACCCCCCC | 88 | 3705 |
| 1129949 | N/A | N/A | 4844 | 4859 | TCTCATCTGCTTTCCG | 35 | 3706 |
| 1129969 | N/A | N/A | 5160 | 5175 | TTGTCCGGGTTCCTGT | 67 | 3707 |
| 1129989 | N/A | N/A | 5443 | 5458 | GAGCCCGCGGCCGGCT | 93 | 3708 |
| 1130009 | N/A | N/A | 5716 | 5731 | GGCGGGTACTCGCCGG | 96 | 3709 |
| 1130029 | N/A | N/A | 5865 | 5880 | CAATCCCGTGTTCCAG | 70 | 3710 |
| 1130049 | N/A | N/A | 6166 | 6181 | AGCTAACCCGGGCGGA | 105 | 3711 |
| 1130069 | N/A | N/A | 6324 | 6339 | TAGCAGTTGTGCCTAC | 70 | 3712 |
| 1130089 | N/A | N/A | 6385 | 6400 | AAGTCGCGGGCTTCTT | 93 | 3713 |
| 1130109 | N/A | N/A | 6407 | 6422 | GTAGGCACCCGGAACG | 79 | 3714 |
| 1130129 | N/A | N/A | 6534 | 6549 | GCAAGTTCGATTCTCC | 70 | 3715 |
| 1130149 | N/A | N/A | 6608 | 6623 | TCCCACACTAGCCCGG | 83 | 3716 |
| 1130169 | N/A | N/A | 6672 | 6687 | TGAATGGGCGGAGCGG | 88 | 3717 |
| 1130189 | N/A | N/A | 6787 | 6802 | GCGCTTGTAAACCCAC | 91 | 3718 |
| 1130209 | N/A | N/A | 6867 | 6882 | GCCCCTGCGAACACAG | 85 | 3719 |
| 1130229 | N/A | N/A | 7057 | 7072 | GCCTGACGGCCTCGGG | 77[†] | 3720 |
| 1130249 | N/A | N/A | 7107 | 7122 | TCACCCTGGGTCGGAA | 86[†] | 3721 |

TABLE 60

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128749 | 104 | 119 | N/A | N/A | CCCAAGGTGGAATCGA | 63 | 3722 |
| 1128769 | 153 | 168 | N/A | N/A | AGAACGACTGTGTGCT | 33 | 3723 |
| 1128789 | 178 | 193 | 3529 | 3544 | GTGGCAGGGCTCCCCG | 44 | 3724 |
| 1128802 | 218 | 233 | 3569 | 3584 | TACATTTGTGGTACAG | 24 | 2426 |
| 1128810 | 226 | 241 | 3577 | 3592 | CTTGTGGGTACATTTG | 40 | 3725 |
| 1128830 | 291 | 306 | 3798 | 3813 | CCCCATCGCTGGTCCT | 40 | 3726 |
| 1128850 | 381 | 396 | 4189 | 4204 | CCGCTTGGCATGTTCA | 49 | 3727 |
| 1128870 | 470 | 485 | 4415 | 4430 | TGTGGAAAAACCGGAG | 27 | 3728 |
| 1128890 | 541 | 556 | 4486 | 4501 | GTGGGCATCAGGACCC | 91 | 3729 |
| 1128910 | 594 | 609 | 4678 | 4693 | CCCCCATGGAGGCACG | 63 | 3730 |
| 1128930 | 627 | 642 | 4711 | 4726 | CACAGGCGGTGGCCCT | 53 | 3731 |
| 1128950 | 661 | 676 | 4745 | 4760 | GCAGAAGGCTCCGGTG | 118 | 3732 |
| 1128970 | 706 | 721 | 4935 | 4950 | GCTGAGCCCGCGGCCA | 61 | 3733 |
| 1128990 | 755 | 770 | 4984 | 4999 | ACGGCTGACAGGGCGC | 61 | 3734 |
| 1129010 | 804 | 819 | 5033 | 5048 | TTCCGCGCTTGCTCGG | 129 | 3735 |
| 1129030 | 845 | 860 | N/A | N/A | TGTCCGGGTTCCGGCA | 52 | 3736 |
| 1129050 | 887 | 902 | 5201 | 5216 | GCCGGTCGCGGTTCAG | 47 | 3737 |
| 1129070 | 979 | 994 | 5293 | 5308 | GAGTGGGACATGAAGC | 74 | 3738 |
| 1129090 | 1013 | 1028 | 5327 | 5342 | GCTGAGGCTTCGGCGG | 52 | 3739 |
| 1129110 | 1085 | 1100 | 5504 | 5519 | GGGAAGGCGGCTGCTC | 68 | 3740 |
| 1129130 | 1126 | 1141 | 5545 | 5560 | GCGGAGCCGCTGCCCG | 76 | 3741 |
| 1129150 | 1147 | 1162 | 5566 | 5581 | GGTCATCGAAGACAGA | 52 | 3742 |
| 1129170 | 1206 | 1221 | 5625 | 5640 | TACAGCGCGGCGATGT | 106 | 3743 |
| 1129190 | 1236 | 1251 | 5655 | 5670 | AGGCTGCCGGCGCAGA | 51 | 3744 |
| 1129210 | 1314 | 1329 | 5974 | 5989 | AGCACCACCGTCAGAT | 72 | 3745 |
| 1129230 | 1381 | 1396 | 6041 | 6056 | CAAGCGGTAGGAGCGC | 61 | 3746 |
| 1129250 | 1435 | 1450 | N/A | N/A | AAGGCGCAACAGAGCC | 60 | 3747 |
| 1129270 | 1459 | 1474 | 6202 | 6217 | GCAGCTGCCGTCCGCA | 54 | 3748 |
| 1129290 | 1494 | 1509 | 6237 | 6252 | AGGCACACCGGCTGAA | 63 | 3749 |
| 1129310 | 1546 | 1561 | 6289 | 6304 | GCCGGCCACCTGGCAG | 93 | 3750 |
| 1129330 | 1577 | 1592 | N/A | N/A | ATTCCTCCGCCCCCTC | 189 | 3751 |
| 1129350 | 1616 | 1631 | 6914 | 6929 | AGAGGAACGGTACCTG | 99 | 3752 |
| 1129370 | 1690 | 1705 | 6988 | 7003 | GAGGAACCCTGCGCAG | 17† | 3753 |
| 1129390 | 1714 | 1729 | 7012 | 7027 | CTGGCACGCATCGGTG | 30† | 3754 |
| 1129410 | 1789 | 1804 | 7177 | 7192 | GCTGATGATGCCTTGC | 42 | 3755 |
| 1129430 | 1825 | 1840 | 7213 | 7228 | GCCTGGCTTGTTGCGG | 60 | 3756 |

TABLE 60-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129450 | 1856 | 1871 | 7244 | 7259 | AGGCCAGGTAGTAGGC | 92 | 3757 |
| 1129470 | 1895 | 1910 | 7283 | 7298 | AGTCCCTGAGCAATCA | 53 | 3758 |
| 1129490 | 1926 | 1941 | 7314 | 7329 | TCACTGCGGAATCACC | 17 | 3759 |
| 1129510 | 1984 | 1999 | 7372 | 7387 | AGCTGGCCGCACTGGG | 36 | 3760 |
| 1129530 | 2008 | 2023 | 7396 | 7411 | AGTTCCTGCGCCATCC | 19 | 3761 |
| 1129550 | N/A | N/A | 94 | 109 | CACCGAAAGTGTTGAC | 118 | 3762 |
| 1129570 | N/A | N/A | 149 | 164 | CTGTGATAGCGACCCC | 96 | 3763 |
| 1129590 | N/A | N/A | 325 | 340 | CCCCCCGTTGTCTTCT | 118 | 3764 |
| 1129610 | N/A | N/A | 427 | 442 | CTATAAGTCATAGCCT | 139 | 3765 |
| 1129630 | N/A | N/A | 602 | 617 | TAGACTAGACTGCCCT | 78 | 3766 |
| 1129650 | N/A | N/A | 644 | 659 | CTCTAGTGCCCATGGG | 75 | 3767 |
| 1129670 | N/A | N/A | 866 | 881 | CCCATTGAAGGCCCTG | 75 | 3768 |
| 1129690 | N/A | N/A | 1024 | 1039 | ACCCTAAGAGGTTTAC | 106 | 3769 |
| 1129710 | N/A | N/A | 1522 | 1537 | TGCCACACTCTAGGTA | 98 | 3770 |
| 1129730 | N/A | N/A | 1699 | 1714 | GCACCAAGTTTGGGTA | 100 | 3771 |
| 1129750 | N/A | N/A | 2141 | 2156 | AAGTGCACTTGCCAAG | 107 | 3772 |
| 1129770 | N/A | N/A | 2376 | 2391 | GCTGTTGGTTGATGAA | 85 | 3773 |
| 1129790 | N/A | N/A | 2524 | 2539 | CAAGAAGGCTACCTTA | 146 | 3774 |
| 1129810 | N/A | N/A | 2708 | 2723 | CATTCCCAGTTAAGGT | 85 | 3775 |
| 1129830 | N/A | N/A | 3039 | 3054 | GATAGCTGGAGTAGAC | 108 | 3776 |
| 1129850 | N/A | N/A | 3609 | 3624 | TAGTCTTACCAGGGCT | 82 | 3777 |
| 1129870 | N/A | N/A | 3995 | 4010 | ATGGGACCACTCCTTC | 76 | 3778 |
| 1129890 | N/A | N/A | 4311 | 4326 | GCAACCTATTCTGTAG | 109 | 3779 |
| 1129910 | N/A | N/A | 4348 | 4363 | GGAGAGTCTAGGACCA | 115 | 3780 |
| 1129930 | N/A | N/A | 4616 | 4631 | GGCCTAAAGACCCCCC | 143 | 3781 |
| 1129950 | N/A | N/A | 5067 | 5082 | GCACCGGCAGAAGGCG | 63 | 3782 |
| 1129970 | N/A | N/A | 5374 | 5389 | TTCCTAACCTCCCGGG | 97 | 3783 |
| 1129990 | N/A | N/A | 5446 | 5461 | GGAGAGCCCGCGGCCG | 95 | 3784 |
| 1130010 | N/A | N/A | 5752 | 5767 | ACGGAGGAGCCGCGGC | 62 | 3785 |
| 1130030 | N/A | N/A | 5866 | 5881 | CCAATCCCGTGTTCCA | 84 | 3786 |
| 1130050 | N/A | N/A | 6167 | 6182 | GAGCTAACCCGGGCGG | 96 | 3787 |
| 1130070 | N/A | N/A | 6327 | 6342 | CCCTAGCAGTTGTGCC | 104 | 3788 |
| 1130090 | N/A | N/A | 6386 | 6401 | AAAGTCGCGGGCTTCT | 92 | 3789 |
| 1130110 | N/A | N/A | 6409 | 6424 | CTGTAGGCACCCGGAA | 164 | 3790 |
| 1130130 | N/A | N/A | 6535 | 6550 | AGCAAGTTCGATTCTC | 80 | 3791 |

TABLE 60-continued

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1130150 | N/A | N/A | 6621 | 6636 | CGCAGAACCTGGCTCC | 95 | 3792 |
| 1130170 | N/A | N/A | 6673 | 6688 | TTGAATGGGCGGAGCG | 126 | 3793 |
| 1130190 | N/A | N/A | 6809 | 6824 | ACGATGGACAAAGCTG | 147 | 3794 |
| 1130210 | N/A | N/A | 6870 | 6885 | TCCGCCCTGCGAACA | 143 | 3795 |
| 1130230 | N/A | N/A | 7064 | 7079 | GATTTGTGCCTGACGG | 93† | 3796 |
| 1130250 | N/A | N/A | 7109 | 7124 | AATCACCCTGGGTCGG | 115† | 3797 |

TABLE 61

Reduction of FXII RNA by 3-10-3 cEt gapmers with uniform PS internucleoside linkages
(Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128750 | 105 | 120 | N/A | N/A | TCCCAAGGTGGAATCG | 66 | 3798 |
| 1128770 | 154 | 169 | N/A | N/A | GAGAACGACTGTGTGC | 47 | 3799 |
| 1128790 | 198 | 213 | 3549 | 3564 | CGGTGGTACTGGAAGG | 45 | 3800 |
| 1128802 | 218 | 233 | 3569 | 3584 | TACATTTGTGGTACAG | 28 | 2426 |
| 1128811 | 228 | 243 | 3579 | 3594 | CCCTTGTGGGTACATT | 75 | 3801 |
| 1128831 | 292 | 307 | 3799 | 3814 | TCCCCATCGCTGGTCC | 70 | 3802 |
| 1128851 | 382 | 397 | 4190 | 4205 | GCCGCTTGGCATGTTC | 53 | 3803 |
| 1128871 | 472 | 487 | 4417 | 4432 | CTTGTGGAAAAACCGG | 37 | 3804 |
| 1128891 | 542 | 557 | 4487 | 4502 | AGTGGGCATCAGGACC | 64 | 3805 |
| 1128911 | 595 | 610 | 4679 | 4694 | ACCCCCATGGAGGCAC | 49 | 3806 |
| 1128931 | 628 | 643 | 4712 | 4727 | GCACAGGCGGTGGCCC | 66 | 3807 |
| 1128951 | 662 | 677 | 4746 | 4761 | CGCAGAAGGCTCCGGT | 95 | 3808 |
| 1128971 | 711 | 726 | 4940 | 4955 | CGGTAGCTGAGCCCGC | 102 | 3809 |
| 1128991 | 756 | 771 | 4985 | 5000 | CACGGCTGACAGGGCG | 53 | 3810 |
| 1129011 | 805 | 820 | 5034 | 5049 | GTTCCGCGCTTGCTCG | 43 | 3811 |
| 1129031 | 846 | 861 | N/A | N/A | TTGTCCGGGTTCCGGC | 47 | 3812 |
| 1129051 | 888 | 903 | 5202 | 5217 | AGCCGGTCGCGGTTCA | 18 | 3813 |
| 1129071 | 980 | 995 | 5294 | 5309 | TGAGTGGGACATGAAG | 50 | 3814 |
| 1129091 | 1014 | 1029 | 5328 | 5343 | GGCTGAGGCTTCGGCG | 54 | 3815 |
| 1129111 | 1086 | 1101 | 5505 | 5520 | AGGGAAGGCGGCTGCT | 44 | 3816 |
| 1129131 | 1127 | 1142 | 5546 | 5561 | TGCGGAGCCGCTGCCC | 59 | 3817 |
| 1129151 | 1150 | 1165 | 5569 | 5584 | GCGGGTCATCGAAGAC | 52 | 3818 |
| 1129171 | 1207 | 1222 | 5626 | 5641 | GTACAGCGCGGCGATG | 57 | 3819 |

TABLE 61-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129191 | 1238 | 1253 | 5657 | 5672 | TGAGGCTGCCGGCGCA | 65 | 3820 |
| 1129211 | 1315 | 1330 | 5975 | 5990 | GAGCACCACCGTCAGA | 36 | 3821 |
| 1129231 | 1382 | 1397 | 6042 | 6057 | GCAAGCGGTAGGAGCG | 53 | 3822 |
| 1129251 | 1436 | 1451 | 6179 | 6194 | GAAGGCGCAACAGAGC | 60 | 3823 |
| 1129271 | 1460 | 1475 | 6203 | 6218 | CGCAGCTGCCGTCCGC | 50 | 3824 |
| 1129291 | 1495 | 1510 | 6238 | 6253 | CAGGCACACCGGCTGA | 53 | 3825 |
| 1129311 | 1554 | 1569 | 6297 | 6312 | TGGCCCCAGCCGGCCA | 78 | 3826 |
| 1129331 | 1578 | 1593 | N/A | N/A | TATTCCTCCGCCCCCT | 140 | 3827 |
| 1129351 | 1617 | 1632 | 6915 | 6930 | GAGAGGAACGGTACCT | 120 | 3828 |
| 1129371 | 1691 | 1706 | 6989 | 7004 | CGAGGAACCCTGCGCA | 41† | 3829 |
| 1129391 | 1746 | 1761 | 7134 | 7149 | TCCTCACACACCAGCG | 15† | 3830 |
| 1129411 | 1790 | 1805 | 7178 | 7193 | AGCTGATGATGCCTTG | 40 | 3831 |
| 1129431 | 1826 | 1841 | 7214 | 7229 | CGCCTGGCTTGTTGCG | 83 | 3832 |
| 1129451 | 1864 | 1879 | 7252 | 7267 | CCGGATCCAGGCCAGG | 66 | 3833 |
| 1129471 | 1896 | 1911 | 7284 | 7299 | GAGTCCCTGAGCAATC | 43 | 3834 |
| 1129491 | 1927 | 1942 | 7315 | 7330 | CTCACTGCGGAATCAC | 21 | 3835 |
| 1129511 | 1988 | 2003 | 7376 | 7391 | GCGGAGCTGGCCGCAC | 56 | 3836 |
| 1129531 | 2009 | 2024 | 7397 | 7412 | GAGTTCCTGCGCCATC | 18 | 3837 |
| 1129551 | N/A | N/A | 95 | 110 | TCACCGAAAGTGTTGA | 86 | 3838 |
| 1129571 | N/A | N/A | 150 | 165 | GCTGTGATAGCGACCC | 78 | 3839 |
| 1129591 | N/A | N/A | 326 | 341 | TCCCCCCGTTGTCTTC | 116 | 3840 |
| 1129611 | N/A | N/A | 428 | 443 | ACTATAAGTCATAGCC | 95 | 3841 |
| 1129631 | N/A | N/A | 603 | 618 | CTAGACTAGACTGCCC | 92 | 3842 |
| 1129651 | N/A | N/A | 645 | 660 | ACTCTAGTGCCCATGG | 86 | 3843 |
| 1129671 | N/A | N/A | 867 | 882 | GCCCATTGAAGGCCCT | 83 | 3844 |
| 1129691 | N/A | N/A | 1053 | 1068 | ATACCTCACATGGGTT | 145 | 3845 |
| 1129711 | N/A | N/A | 1555 | 1570 | GTAAGGTCCATCTGGT | 72 | 3846 |
| 1129731 | N/A | N/A | 1704 | 1719 | ATAGGGCACCAAGTTT | 93 | 3847 |
| 1129751 | N/A | N/A | 2143 | 2158 | CAAAGTGCACTTGCCA | 73 | 3848 |
| 1129771 | N/A | N/A | 2445 | 2460 | GATGAATCAGCAACAC | 56 | 3849 |
| 1129791 | N/A | N/A | 2525 | 2540 | ACAAGAAGGCTACCTT | 79 | 3850 |
| 1129811 | N/A | N/A | 2746 | 2761 | CCATTTGTGGGCATGC | 64 | 3851 |
| 1129831 | N/A | N/A | 3040 | 3055 | AGATAGCTGGAGTAGA | 87 | 3852 |
| 1129851 | N/A | N/A | 3610 | 3625 | GTAGTCTTACCAGGGC | 72 | 3853 |
| 1129871 | N/A | N/A | 3996 | 4011 | AATGGGACCACTCCTT | 60 | 3854 |

TABLE 61-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129891 | N/A | N/A | 4312 | 4327 | AGCAACCTATTCTGTA | 95 | 3855 |
| 1129911 | N/A | N/A | 4349 | 4364 | AGGAGAGTCTAGGACC | 116 | 3856 |
| 1129931 | N/A | N/A | 4617 | 4632 | GGGCCTAAAGACCCCC | 94 | 3857 |
| 1129951 | N/A | N/A | 5068 | 5083 | CGCACCGGCAGAAGGC | 75 | 3858 |
| 1129971 | N/A | N/A | 5375 | 5390 | CTTCCTAACCTCCCGG | 76 | 3859 |
| 1129991 | N/A | N/A | 5448 | 5463 | ACGGAGAGCCCGCGGC | 94 | 3860 |
| 1130011 | N/A | N/A | 5753 | 5768 | GACGGAGGAGCCGCGG | 98 | 3861 |
| 1130031 | N/A | N/A | 5867 | 5882 | CCCAATCCCGTGTTCC | 76 | 3862 |
| 1130051 | N/A | N/A | 6168 | 6183 | AGAGCTAACCCGGGCG | 91 | 3863 |
| 1130071 | N/A | N/A | 6328 | 6343 | CCCCTAGCAGTTGTGC | 76 | 3864 |
| 1130091 | N/A | N/A | 6387 | 6402 | CAAAGTCGCGGGCTTC | 67 | 3865 |
| 1130111 | N/A | N/A | 6410 | 6425 | TCTGTAGGCACCCGGA | 73 | 3866 |
| 1130131 | N/A | N/A | 6536 | 6551 | GAGCAAGTTCGATTCT | 81 | 3867 |
| 1130151 | N/A | N/A | 6622 | 6637 | TCGCAGAACCTGGCTC | 76 | 3868 |
| 1130171 | N/A | N/A | 6674 | 6689 | TTTGAATGGGCGGAGC | 84 | 3869 |
| 1130191 | N/A | N/A | 6810 | 6825 | GACGATGGACAAAGCT | 82 | 3870 |
| 1130211 | N/A | N/A | 6871 | 6886 | CTCCGCCCTGCGAAC | 122 | 3871 |
| 1130231 | N/A | N/A | 7065 | 7080 | AGATTTGTGCCTGACG | 84† | 3872 |
| 1130251 | N/A | N/A | 7111 | 7126 | GGAATCACCCTGGGTC | 55† | 3873 |

TABLE 62

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128751 | 107 | 122 | 474 | 489 | CTTCCCAAGGTGGAAT | 89 | 3874 |
| 1128771 | 155 | 170 | N/A | N/A | TGAGAACGACTGTGTG | 49 | 3875 |
| 1128791 | 199 | 214 | 3550 | 3565 | CCGGTGGTACTGGAAG | 55 | 3876 |
| 1128802 | 218 | 233 | 3569 | 3584 | TACATTTGTGGTACAG | 12 | 2426 |
| 1128812 | 229 | 244 | 3580 | 3595 | GCCCTTGTGGGTACAT | 56 | 3877 |
| 1128832 | 293 | 308 | 3800 | 3815 | ATCCCCATCGCTGGTC | 36 | 3878 |
| 1128852 | 383 | 398 | 4191 | 4206 | GGCCGCTTGGCATGTT | 54 | 3879 |
| 1128872 | 480 | 495 | 4425 | 4440 | ATCTCATTCTTGTGGA | 32 | 3880 |
| 1128892 | 543 | 558 | 4488 | 4503 | CAGTGGGCATCAGGAC | 48 | 3881 |
| 1128912 | 597 | 612 | 4681 | 4696 | CGACCCCATGGAGGC | 36 | 3882 |

TABLE 62-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128932 | 630 | 645 | 4714 | 4729 | TGGCACAGGCGGTGGC | 52 | 3883 |
| 1128952 | 663 | 678 | 4747 | 4762 | TCGCAGAAGGCTCCGG | 87 | 3884 |
| 1128972 | 712 | 727 | 4941 | 4956 | GCGGTAGCTGAGCCCG | 66 | 3885 |
| 1128992 | 758 | 773 | 4987 | 5002 | CCCACGGCTGACAGGG | 73 | 3886 |
| 1129012 | 806 | 821 | 5035 | 5050 | AGTTCCGCGCTTGCTC | 34 | 3887 |
| 1129032 | 862 | 877 | 5176 | 5191 | CCACGGGCGGATGTCG | 43 | 3888 |
| 1129052 | 889 | 904 | 5203 | 5218 | CAGCCGGTCGCGGTTC | 38 | 3889 |
| 1129072 | 981 | 996 | 5295 | 5310 | ATGAGTGGGACATGAA | 55 | 3890 |
| 1129092 | 1016 | 1031 | 5330 | 5345 | TGGGCTGAGGCTTCGG | 25 | 3891 |
| 1129112 | 1088 | 1103 | 5507 | 5522 | TCAGGGAAGGCGGCTG | 45 | 3892 |
| 1129132 | 1128 | 1143 | 5547 | 5562 | TTGCGGAGCCGCTGCC | 58 | 3893 |
| 1129152 | 1151 | 1166 | 5570 | 5585 | CGCGGGTCATCGAAGA | 44 | 3894 |
| 1129172 | 1208 | 1223 | 5627 | 5642 | AGTACAGCGCGGCGAT | 31 | 3895 |
| 1129192 | 1239 | 1254 | 5658 | 5673 | ATGAGGCTGCCGGCGC | 43 | 3896 |
| 1129212 | 1318 | 1333 | 5978 | 5993 | GCCGAGCACCACCGTC | 40 | 3897 |
| 1129232 | 1383 | 1398 | 6043 | 6058 | TGCAAGCGGTAGGAGC | 33 | 3898 |
| 1129252 | 1437 | 1452 | 6180 | 6195 | TGAAGGCGCAACAGAG | 44 | 3899 |
| 1129272 | 1462 | 1477 | 6205 | 6220 | CGCGCAGCTGCCGTCC | 43 | 3900 |
| 1129292 | 1496 | 1511 | 6239 | 6254 | GCAGGCACACCGGCTG | 34 | 3901 |
| 1129312 | 1556 | 1571 | 6299 | 6314 | GGTGGCCCCAGCCGGC | 60 | 3902 |
| 1129332 | 1579 | 1594 | N/A | N/A | ATATTCCTCCGCCCCC | 89 | 3903 |
| 1129352 | 1618 | 1633 | 6916 | 6931 | GGAGAGGAACGGTACC | 89 | 3904 |
| 1129372 | 1692 | 1707 | 6990 | 7005 | TCGAGGAACCCTGCGC | 46† | 3905 |
| 1129392 | 1747 | 1762 | 7135 | 7150 | GTCCTCACACACCAGC | 5† | 3906 |
| 1129412 | 1797 | 1812 | 7185 | 7200 | GATCCCCAGCTGATGA | 43 | 3907 |
| 1129432 | 1827 | 1842 | 7215 | 7230 | ACGCCTGGCTTGTTGC | 43 | 3908 |
| 1129452 | 1865 | 1880 | 7253 | 7268 | CCCGGATCCAGGCCAG | 41 | 3909 |
| 1129472 | 1897 | 1912 | 7285 | 7300 | TGAGTCCCTGAGCAAT | 24 | 3910 |
| 1129492 | 1928 | 1943 | 7316 | 7331 | TCTCACTGCGGAATCA | 14 | 3911 |
| 1129512 | 1989 | 2004 | 7377 | 7392 | CGCGGAGCTGGCCGCA | 39 | 3912 |
| 1129532 | 2010 | 2025 | 7398 | 7413 | TGAGTTCCTGCGCCAT | 16 | 3913 |
| 1129552 | N/A | N/A | 96 | 111 | CTCACCGAAAGTGTTG | 88 | 3914 |
| 1129572 | N/A | N/A | 186 | 201 | GGACCCACAGGTCATG | 28 | 3915 |
| 1129592 | N/A | N/A | 327 | 342 | CTCCCCCGTTGTCTT | 85 | 3916 |
| 1129612 | N/A | N/A | 429 | 444 | GACTATAAGTCATAGC | 101 | 3917 |

TABLE 62-continued

Reduction of FXII RNA by 3-10-3 cEt gapmers with uniform PS internucleoside linkages (Huh7, electroporation, 3000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1129632 | N/A | N/A | 604 | 619 | ACTAGACTAGACTGCC | 79 | 3918 |
| 1129652 | N/A | N/A | 649 | 664 | GATCACTCTAGTGCCC | 49 | 3919 |
| 1129672 | N/A | N/A | 889 | 904 | GACAAGCTCTTGATCC | 40 | 3920 |
| 1129692 | N/A | N/A | 1054 | 1069 | AATACCTCACATGGGT | 51 | 3921 |
| 1129712 | N/A | N/A | 1556 | 1571 | GGTAAGGTCCATCTGG | 47 | 3922 |
| 1129732 | N/A | N/A | 1708 | 1723 | AAGGATAGGGCACCAA | 53 | 3923 |
| 1129752 | N/A | N/A | 2145 | 2160 | GGCAAAGTGCACTTGC | 80 | 3924 |
| 1129772 | N/A | N/A | 2449 | 2464 | CATTGATGAATCAGCA | 53 | 3925 |
| 1129792 | N/A | N/A | 2526 | 2541 | CACAAGAAGGCTACCT | 69 | 3926 |
| 1129812 | N/A | N/A | 2806 | 2821 | GTGCCTACTTGCTGAA | 72 | 3927 |
| 1129832 | N/A | N/A | 3041 | 3056 | CAGATAGCTGGAGTAG | 39 | 3928 |
| 1129852 | N/A | N/A | 3647 | 3662 | GTACATGTCTCCCAGG | 55 | 3929 |
| 1129872 | N/A | N/A | 4014 | 4029 | TGGTTTACCCACCTGC | 59 | 3930 |
| 1129892 | N/A | N/A | 4313 | 4328 | CAGCAACCTATTCTGT | 88 | 3931 |
| 1129912 | N/A | N/A | 4350 | 4365 | CAGGAGAGTCTAGGAC | 69 | 3932 |
| 1129932 | N/A | N/A | 4618 | 4633 | TGGGCCTAAAGACCCC | 96 | 3933 |
| 1129952 | N/A | N/A | 5069 | 5084 | GCGCACCGGCAGAAGG | 101 | 3934 |
| 1129972 | N/A | N/A | 5376 | 5391 | ACTTCCTAACCTCCCG | 56 | 3935 |
| 1129992 | N/A | N/A | 5449 | 5464 | GACGGAGAGCCCGCGG | 88 | 3936 |
| 1130012 | N/A | N/A | 5754 | 5769 | AGACGGAGGAGCCGCG | 59 | 3937 |
| 1130032 | N/A | N/A | 5868 | 5883 | CCCCAATCCCGTGTTC | 82 | 3938 |
| 1130052 | N/A | N/A | 6169 | 6184 | CAGAGCTAACCCGGGC | 69 | 3939 |
| 1130072 | N/A | N/A | 6329 | 6344 | GCCCCTAGCAGTTGTG | 86 | 3940 |
| 1130092 | N/A | N/A | 6388 | 6403 | CCAAAGTCGCGGGCTT | 54 | 3941 |
| 1130112 | N/A | N/A | 6412 | 6427 | ATTCTGTAGGCACCCG | 46 | 3942 |
| 1130132 | N/A | N/A | 6537 | 6552 | AGAGCAAGTTCGATTC | 51 | 3943 |
| 1130152 | N/A | N/A | 6623 | 6638 | GTCGCAGAACCTGGCT | 60 | 3944 |
| 1130172 | N/A | N/A | 6675 | 6690 | ATTTGAATGGGCGGAG | 44 | 3945 |
| 1130192 | N/A | N/A | 6811 | 6826 | GGACGATGGACAAAGC | 66 | 3946 |
| 1130212 | N/A | N/A | 6873 | 6888 | TCCTCCGCCCCTGCGA | 152 | 3947 |
| 1130232 | N/A | N/A | 7066 | 7081 | GAGATTTGTGCCTGAC | 65[†] | 3948 |
| 1130252 | N/A | N/A | 7112 | 7127 | CGGAATCACCCTGGGT | 22[†] | 3949 |

TABLE 63

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128802 | 218 | 233 | 3569 | 3584 | TACATTTGTGGTACAG | 124 | 2426 |
| 1129531 | 2009 | 2024 | 7397 | 7412 | GAGTTCCTGCGCCATC | 13 | 3837 |
| 1129948 | N/A | N/A | 4840 | 4855 | ATCTGCTTTCCGCACT | 134 | 3630 |
| 1194296 | N/A | N/A | 4848 | 4863 | TCCCTCTCATCTGCTT | 55 | 3950 |
| 1206493 | N/A | N/A | 4830 | 4845 | CGCACTCTCCCTCCTC | 105 | 3951 |
| 1208291 | N/A | N/A | 130 | 145 | GAACAATCCTGGGACA | 84 | 3952 |
| 1208323 | N/A | N/A | 200 | 215 | CCTCCTAGTCACCTGG | 44 | 3953 |
| 1208358 | N/A | N/A | 269 | 284 | ATCCACCCAGTCTGGT | 123 | 3954 |
| 1208388 | N/A | N/A | 315 | 330 | TCTTCTTAAGGCCCAT | 76 | 3955 |
| 1208422 | N/A | N/A | 407 | 422 | CCGATCTGTTGCTAGT | 113 | 3956 |
| 1208453 | N/A | N/A | 442 | 457 | AAGGCAGGGAACTGAC | 91 | 3957 |
| 1208484 | N/A | N/A | 531 | 546 | AGCCAGGCCACTTACC | 123 | 3958 |
| 1208512 | N/A | N/A | 599 | 614 | ACTAGACTGCCCTGAG | 102 | 3959 |
| 1208540 | N/A | N/A | 632 | 647 | TGGGCATAAGACCTAG | 113 | 3960 |
| 1208572 | N/A | N/A | 662 | 677 | TCACACAGCTCACGAT | 77 | 3961 |
| 1208588 | N/A | N/A | 734 | 749 | ACATATCTCAAGCACC | 119 | 3962 |
| 1208601 | N/A | N/A | 841 | 856 | TGGCATGAATGATGCC | 127 | 3963 |
| 1208614 | N/A | N/A | 887 | 902 | CAAGCTCTTGATCCTT | 56 | 3964 |
| 1208627 | N/A | N/A | 927 | 942 | GTGATAAAGCTGGGCT | 101 | 3965 |
| 1208640 | N/A | N/A | 969 | 984 | TGGAGAACTCAAATCC | 52 | 3966 |
| 1208653 | N/A | N/A | 1015 | 1030 | GGTTTACTGTTATCAA | 120 | 3967 |
| 1208666 | N/A | N/A | 1057 | 1072 | CTGAATACCTCACATG | 107 | 3968 |
| 1208679 | N/A | N/A | 1126 | 1141 | TTCATCTAAAAGGTAG | 73 | 3969 |
| 1208692 | N/A | N/A | 1165 | 1180 | TATGGCAGAGCTTGAG | 72 | 3970 |
| 1208705 | N/A | N/A | 1517 | 1532 | CACTCTAGGTAAATTT | 84 | 3971 |
| 1208718 | N/A | N/A | 1567 | 1582 | AGGCCCACCAGGGTAA | 111 | 3972 |
| 1208735 | N/A | N/A | 1597 | 1612 | CCATGCTTAGAGACTC | 83 | 3973 |
| 1208762 | N/A | N/A | 1690 | 1705 | TTGGGTAAGGCAAGAG | 48 | 3974 |
| 1208789 | N/A | N/A | 1718 | 1733 | GGGATTAGGCAAGGAT | 74 | 3975 |
| 1208813 | N/A | N/A | 1921 | 1936 | CTGAGCATGAAGTTGT | 80 | 3976 |
| 1208840 | N/A | N/A | 2094 | 2109 | ATGGATCTGAGATGGA | 52 | 3977 |
| 1208868 | N/A | N/A | 2126 | 2141 | GGACCAAACCAGAACT | 98 | 3978 |
| 1208895 | N/A | N/A | 2149 | 2164 | TCAAGGCAAAGTGCAC | 47 | 3979 |
| 1208918 | N/A | N/A | 2182 | 2197 | TACCTGCTCAATAAGC | 46 | 3980 |
| 1208944 | N/A | N/A | 2251 | 2266 | CTTCAGAGGAATTGTC | 64 | 3981 |
| 1208971 | N/A | N/A | 2320 | 2335 | GCTAGTTCAATGTTCA | 98 | 3982 |

TABLE 63-continued

Reduction of FXII RNA by 3-10-3 cEt gapmers with uniform PS internucleoside linkages
(Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1208997 | N/A | N/A | 2337 | 2352 | GGAACCTAATACTGTT | 73 | 3983 |
| 1209023 | N/A | N/A | 2389 | 2404 | AACCAGATTATATGCT | 80 | 3984 |
| 1209048 | N/A | N/A | 2461 | 2476 | CCATCAGCTTAGCATT | 53 | 3985 |
| 1209073 | N/A | N/A | 2493 | 2508 | TTAGACACTTGATTCA | 76 | 3986 |
| 1209100 | N/A | N/A | 2548 | 2563 | GAAGAGCTGTGTAGTT | 95 | 3987 |
| 1209126 | N/A | N/A | 2647 | 2662 | GAATGAGTGTCCTTCT | 43 | 3988 |
| 1209152 | N/A | N/A | 2707 | 2722 | ATTCCCAGTTAAGGTT | 78 | 3989 |
| 1209180 | N/A | N/A | 2750 | 2765 | ATGGCCATTTGTGGGC | 98 | 3990 |
| 1209206 | N/A | N/A | 2785 | 2800 | TTTGTAACTCCCAAGT | 80 | 3991 |
| 1209229 | N/A | N/A | 2817 | 2832 | ACATTGAGAATGTGCC | 99 | 3992 |
| 1209253 | N/A | N/A | 2896 | 2911 | TCTGATCTGAGCCTTG | 103 | 3993 |
| 1209277 | N/A | N/A | 2957 | 2972 | CACTTGCCACAAAGTA | 74 | 3994 |
| 1209303 | N/A | N/A | 3019 | 3034 | GACTCCACAACCTGCT | 130 | 3995 |
| 1209329 | N/A | N/A | 3371 | 3386 | TAAAAGTTGGGTTCAG | 78 | 3996 |
| 1209347 | N/A | N/A | 3441 | 3456 | CCTCAGGGTCTGGTCA | 117 | 3997 |
| 1209360 | N/A | N/A | 3474 | 3489 | ACTTCCCCTGTACTCA | 143 | 3998 |
| 1209373 | N/A | N/A | 3511 | 3526 | GACAGTGAGAACTGCA | 123 | 3999 |
| 1209386 | N/A | N/A | 3658 | 3673 | GGACAGGCAGGGTACA | 76 | 4000 |
| 1209399 | N/A | N/A | 3703 | 3718 | CCCTATCACAGTCCCC | 64 | 4001 |
| 1209412 | N/A | N/A | 3879 | 3894 | AATGAGGCGGGAGGAG | 122 | 4002 |
| 1209425 | N/A | N/A | 3923 | 3938 | GTCCAGAATCCCAGGT | 86 | 4003 |
| 1209438 | N/A | N/A | 3998 | 4013 | AAAATGGGACCACTCC | 144 | 4004 |
| 1209451 | N/A | N/A | 4034 | 4049 | CTACTCCAAGTTTCCA | 71 | 4005 |
| 1209464 | N/A | N/A | 4067 | 4082 | GCCCTTCTTGAACCTA | 88 | 4006 |
| 1209477 | N/A | N/A | 4269 | 4284 | ACCCCGCCCAGGTCCT | 48 | 4007 |
| 1209490 | N/A | N/A | 4331 | 4346 | GCCAAGTCTCCGAGTA | 76 | 4008 |
| 1209503 | N/A | N/A | 4364 | 4379 | AGGGATAGTGGTCTCA | 73 | 4009 |
| 1209516 | N/A | N/A | 4609 | 4624 | AGACCCCCCAGAGAG | 71 | 4010 |
| 1209529 | N/A | N/A | 4803 | 4818 | GCCCGTCCCACCTGGG | 78 | 4011 |
| 1209542 | N/A | N/A | 5119 | 5134 | GCGCCGGGAGCCCGGA | 62 | 4012 |
| 1209555 | N/A | N/A | 5430 | 5445 | GCTGGCCGGAATCTAG | 61 | 4013 |
| 1209568 | N/A | N/A | 5745 | 5760 | AGCCGCGGCCCCTGGG | 49 | 4014 |
| 1209581 | N/A | N/A | 5860 | 5875 | CCGTGTTCCAGCTTCC | 53 | 4015 |
| 1209594 | N/A | N/A | 6095 | 6110 | GCGCCCCACGCACCC | 74 | 4016 |
| 1209607 | N/A | N/A | 6357 | 6372 | GTGATCAAAGGTCTCC | 26 | 4017 |

TABLE 63-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209620 | N/A | N/A | 6436 | 6451 | CAACCCATCAGGTCAG | 41 | 4018 |
| 1209633 | N/A | N/A | 6474 | 6489 | CCCTGGGATTCTACCT | 65 | 4019 |
| 1209646 | N/A | N/A | 6542 | 6557 | AACCAAGAGCAAGTTC | 38 | 4020 |
| 1209659 | N/A | N/A | 6625 | 6640 | GAGTCGCAGAACCTGG | 25 | 4021 |
| 1209672 | N/A | N/A | 6680 | 6695 | CCAGGATTTGAATGGG | 83 | 4022 |
| 1209685 | N/A | N/A | 6780 | 6795 | TAAACCCACTCATGCC | 44 | 4023 |
| 1209698 | N/A | N/A | 6839 | 6854 | ACACCCCATCTGACAA | 63 | 4024 |
| 1209711 | N/A | N/A | 7027 | 7042 | GGGCTAAGAGCTCACC | 88† | 4025 |

TABLE 64

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128802 | 218 | 233 | 3569 | 3584 | TACATTTGTGGTACAG | 88 | 2426 |
| 1129531 | 2009 | 2024 | 7397 | 7412 | GAGTTCCTGCGCCATC | 7 | 3837 |
| 1129948 | N/A | N/A | 4840 | 4855 | ATCTGCTTTCCGCACT | 84 | 3630 |
| 1194286 | N/A | N/A | 4835 | 4850 | CTTTCCGCACTCTCCC | 97 | 4026 |
| 1194297 | N/A | N/A | 4849 | 4864 | CTCCCTCTCATCTGCT | 54 | 4027 |
| 1208292 | N/A | N/A | 131 | 146 | AGAACAATCCTGGGAC | 91 | 4028 |
| 1208327 | N/A | N/A | 201 | 216 | GCCTCCTAGTCACCTG | 108 | 4029 |
| 1208361 | N/A | N/A | 270 | 285 | TATCCACCCAGTCTGG | 73 | 4030 |
| 1208392 | N/A | N/A | 316 | 331 | GTCTTCTTAAGGCCCA | 79 | 4031 |
| 1208426 | N/A | N/A | 413 | 428 | CTGCCACCGATCTGTT | 57 | 4032 |
| 1208454 | N/A | N/A | 460 | 475 | ATCTACAAGGGAGAGA | 107 | 4033 |
| 1208487 | N/A | N/A | 546 | 561 | GTTCCCGGGAGGAGGA | 69 | 4034 |
| 1208513 | N/A | N/A | 601 | 616 | AGACTAGACTGCCCTG | 43 | 4035 |
| 1208544 | N/A | N/A | 633 | 648 | ATGGGCATAAGACCTA | 60 | 4036 |
| 1208575 | N/A | N/A | 664 | 679 | GATCACACAGCTCACG | 112 | 4037 |
| 1208589 | N/A | N/A | 735 | 750 | CACATATCTCAAGCAC | 65 | 4038 |
| 1208602 | N/A | N/A | 842 | 857 | GTGGCATGAATGATGC | 94 | 4039 |
| 1208615 | N/A | N/A | 888 | 903 | ACAAGCTCTTGATCCT | 96 | 4040 |
| 1208628 | N/A | N/A | 928 | 943 | AGTGATAAAGCTGGGC | 89 | 4041 |
| 1208641 | N/A | N/A | 970 | 985 | TTGGAGAACTCAAATC | 81 | 4042 |
| 1208654 | N/A | N/A | 1016 | 1031 | AGGTTTACTGTTATCA | 95 | 4043 |

TABLE 64-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1208667 | N/A | N/A | 1058 | 1073 | GCTGAATACCTCACAT | 74 | 4044 |
| 1208680 | N/A | N/A | 1128 | 1143 | CCTTCATCTAAAAGGT | 113 | 4045 |
| 1208693 | N/A | N/A | 1166 | 1181 | CTATGGCAGAGCTTGA | 111 | 4046 |
| 1208706 | N/A | N/A | 1518 | 1533 | ACACTCTAGGTAAATT | 83 | 4047 |
| 1208719 | N/A | N/A | 1573 | 1588 | CAAGTCAGGCCCACCA | 168 | 4048 |
| 1208738 | N/A | N/A | 1598 | 1613 | GCCATGCTTAGAGACT | 47 | 4049 |
| 1208764 | N/A | N/A | 1691 | 1706 | TTTGGGTAAGGCAAGA | 53 | 4050 |
| 1208792 | N/A | N/A | 1751 | 1766 | TGGACGGACAGAGAGG | 64 | 4051 |
| 1208816 | N/A | N/A | 1922 | 1937 | GCTGAGCATGAAGTTG | 38 | 4052 |
| 1208843 | N/A | N/A | 2111 | 2126 | TAGGACAGTAAATGGA | 64 | 4053 |
| 1208870 | N/A | N/A | 2127 | 2142 | AGGACCAAACCAGAAC | 125 | 4054 |
| 1208896 | N/A | N/A | 2151 | 2166 | GTTCAAGGCAAAGTGC | 68 | 4055 |
| 1208921 | N/A | N/A | 2183 | 2198 | GTACCTGCTCAATAAG | 102 | 4056 |
| 1208947 | N/A | N/A | 2266 | 2281 | AATTGCCTGTGTCTTC | 47 | 4057 |
| 1208973 | N/A | N/A | 2322 | 2337 | TTGCTAGTTCAATGTT | 60 | 4058 |
| 1209000 | N/A | N/A | 2338 | 2353 | AGGAACCTAATACTGT | 104 | 4059 |
| 1209024 | N/A | N/A | 2390 | 2405 | AAACCAGATTATATGC | 75 | 4060 |
| 1209050 | N/A | N/A | 2463 | 2478 | TGCCATCAGCTTAGCA | 72 | 4061 |
| 1209076 | N/A | N/A | 2495 | 2510 | TGTTAGACACTTGATT | 92 | 4062 |
| 1209101 | N/A | N/A | 2549 | 2564 | TGAAGAGCTGTGTAGT | 83 | 4063 |
| 1209127 | N/A | N/A | 2648 | 2663 | TGAATGAGTGTCCTTC | 131 | 4064 |
| 1209155 | N/A | N/A | 2709 | 2724 | ACATTCCCAGTTAAGG | 93 | 4065 |
| 1209183 | N/A | N/A | 2771 | 2786 | GTCAATACTTGAAATG | 88 | 4066 |
| 1209207 | N/A | N/A | 2786 | 2801 | ATTTGTAACTCCCAAG | 108 | 4067 |
| 1209232 | N/A | N/A | 2818 | 2833 | TACATTGAGAATGTGC | 72 | 4068 |
| 1209254 | N/A | N/A | 2901 | 2916 | ACCACTCTGATCTGAG | 70 | 4069 |
| 1209280 | N/A | N/A | 2962 | 2977 | AAGAGCACTTGCCACA | 77 | 4070 |
| 1209305 | N/A | N/A | 3028 | 3043 | TAGACTCCTGACTCCA | 141 | 4071 |
| 1209332 | N/A | N/A | 3372 | 3387 | CTAAAAGTTGGGTTCA | 77 | 4072 |
| 1209348 | N/A | N/A | 3460 | 3475 | CAACTGCTCAGGCACT | 117 | 4073 |
| 1209361 | N/A | N/A | 3485 | 3500 | ACTCTCTGAGGACTTC | 101 | 4074 |
| 1209374 | N/A | N/A | 3605 | 3620 | CTTACCAGGGCTGAGG | 93 | 4075 |
| 1209387 | N/A | N/A | 3660 | 3675 | AAGGACAGGCAGGGTA | 86 | 4076 |
| 1209400 | N/A | N/A | 3705 | 3720 | TGCCCTATCACAGTCC | 96 | 4077 |
| 1209413 | N/A | N/A | 3880 | 3895 | TAATGAGGCGGGAGGA | 106 | 4078 |

TABLE 64-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209426 | N/A | N/A | 3949 | 3964 | TATTGTGGAGGGAGAG | 131 | 4079 |
| 1209439 | N/A | N/A | 3999 | 4014 | CAAAATGGGACCACTC | 58 | 4080 |
| 1209452 | N/A | N/A | 4036 | 4051 | TGCTACTCCAAGTTTC | 72 | 4081 |
| 1209465 | N/A | N/A | 4068 | 4083 | GGCCCTTCTTGAACCT | 47 | 4082 |
| 1209478 | N/A | N/A | 4271 | 4286 | GCACCCCGCCCAGGTC | 90 | 4083 |
| 1209491 | N/A | N/A | 4334 | 4349 | CATGCCAAGTCTCCGA | 73 | 4084 |
| 1209504 | N/A | N/A | 4368 | 4383 | AAAGAGGGATAGTGGT | 47 | 4085 |
| 1209517 | N/A | N/A | 4612 | 4627 | TAAAGACCCCCCCAGA | 95 | 4086 |
| 1209530 | N/A | N/A | 4804 | 4819 | AGCCCGTCCCACCTGG | 97 | 4087 |
| 1209543 | N/A | N/A | 5146 | 5161 | GTAGCCACACGACGGG | 31 | 4088 |
| 1209556 | N/A | N/A | 5431 | 5446 | GGCTGGCCGGAATCTA | 37 | 4089 |
| 1209569 | N/A | N/A | 5746 | 5761 | GAGCCGCGGCCCCTGG | 67 | 4090 |
| 1209582 | N/A | N/A | 5863 | 5878 | ATCCCGTGTTCCAGCT | 58 | 4091 |
| 1209595 | N/A | N/A | 6111 | 6126 | TTCCCGTCCCCGCGGG | 82 | 4092 |
| 1209608 | N/A | N/A | 6359 | 6374 | CAGTGATCAAAGGTCT | 34 | 4093 |
| 1209621 | N/A | N/A | 6439 | 6454 | TCACAACCCATCAGGT | 43 | 4094 |
| 1209634 | N/A | N/A | 6476 | 6491 | GGCCCTGGGATTCTAC | 89 | 4095 |
| 1209647 | N/A | N/A | 6543 | 6558 | GAACCAAGAGCAAGTT | 64 | 4096 |
| 1209660 | N/A | N/A | 6631 | 6646 | CATCCAGAGTCGCAGA | 36 | 4097 |
| 1209673 | N/A | N/A | 6681 | 6696 | GCCAGGATTTGAATGG | 84 | 4098 |
| 1209686 | N/A | N/A | 6782 | 6797 | TGTAAACCCACTCATG | 101 | 4099 |
| 1209699 | N/A | N/A | 6840 | 6855 | CACACCCCATCTGACA | 86 | 4100 |
| 1209712 | N/A | N/A | 7058 | 7073 | TGCCTGACGGCCTCGG | 47† | 4101 |

TABLE 65

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128802 | 218 | 233 | 3569 | 3584 | TACATTTGTGGTACAG | 102 | 2426 |
| 1129531 | 2009 | 2024 | 7397 | 7412 | GAGTTCCTGCGCCATC | 25 | 3837 |
| 1129948 | N/A | N/A | 4840 | 4855 | ATCTGCTTTCCGCACT | 76 | 3630 |
| 1194287 | N/A | N/A | 4836 | 4851 | GCTTTCCGCACTCTCC | 48 | 4102 |
| 1206494 | N/A | N/A | 4854 | 4869 | CCTGCCTCCCTCTCAT | 92 | 4103 |
| 1208296 | N/A | N/A | 133 | 148 | CCAGAACAATCCTGGG | 62 | 4104 |

TABLE 65-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1208328 | N/A | N/A | 203 | 218 | AGGCCTCCTAGTCACC | 56 | 4105 |
| 1208363 | N/A | N/A | 274 | 289 | CTTGTATCCACCCAGT | 79 | 4106 |
| 1208393 | N/A | N/A | 321 | 336 | CCGTTGTCTTCTTAAG | 67 | 4107 |
| 1208427 | N/A | N/A | 414 | 429 | CCTGCCACCGATCTGT | 94 | 4108 |
| 1208458 | N/A | N/A | 461 | 476 | AATCTACAAGGGAGAG | 55 | 4109 |
| 1208489 | N/A | N/A | 547 | 562 | GGTTCCCGGGAGGAGG | 51 | 4110 |
| 1208515 | N/A | N/A | 605 | 620 | CACTAGACTAGACTGC | 69 | 4111 |
| 1208545 | N/A | N/A | 634 | 649 | CATGGGCATAAGACCT | 52 | 4112 |
| 1208577 | N/A | N/A | 672 | 687 | CCCTCAAGGATCACAC | 68 | 4113 |
| 1208590 | N/A | N/A | 738 | 753 | CAGCACATATCTCAAG | 64 | 4114 |
| 1208603 | N/A | N/A | 862 | 877 | TTGAAGGCCCTGGCCT | 45 | 4115 |
| 1208616 | N/A | N/A | 895 | 910 | GCCAGAGACAAGCTCT | 87 | 4116 |
| 1208629 | N/A | N/A | 932 | 947 | CATAAGTGATAAAGCT | 79 | 4117 |
| 1208642 | N/A | N/A | 975 | 990 | GAAGCTTGGAGAACTC | 88 | 4118 |
| 1208655 | N/A | N/A | 1018 | 1033 | AGAGGTTTACTGTTAT | 57 | 4119 |
| 1208668 | N/A | N/A | 1062 | 1077 | ATGGGCTGAATACCTC | 95 | 4120 |
| 1208681 | N/A | N/A | 1129 | 1144 | CCCTTCATCTAAAAGG | 133 | 4121 |
| 1208694 | N/A | N/A | 1167 | 1182 | GCTATGGCAGAGCTTG | 84 | 4122 |
| 1208707 | N/A | N/A | 1519 | 1534 | CACACTCTAGGTAAAT | 76 | 4123 |
| 1208720 | N/A | N/A | 1574 | 1589 | CCAAGTCAGGCCCACC | 74 | 4124 |
| 1208739 | N/A | N/A | 1600 | 1615 | ACGCCATGCTTAGAGA | 76 | 4125 |
| 1208766 | N/A | N/A | 1692 | 1707 | GTTTGGGTAAGGCAAG | 60 | 4126 |
| 1208795 | N/A | N/A | 1756 | 1771 | TGGGATGGACGGACAG | 83 | 4127 |
| 1208817 | N/A | N/A | 1923 | 1938 | AGCTGAGCATGAAGTT | 144 | 4128 |
| 1208844 | N/A | N/A | 2112 | 2127 | CTAGGACAGTAAATGG | 73 | 4129 |
| 1208873 | N/A | N/A | 2129 | 2144 | CAAGGACCAAACCAGA | 91 | 4130 |
| 1208898 | N/A | N/A | 2152 | 2167 | TGTTCAAGGCAAAGTG | 72 | 4131 |
| 1208922 | N/A | N/A | 2190 | 2205 | GCACAAAGTACCTGCT | 71 | 4132 |
| 1208948 | N/A | N/A | 2267 | 2282 | GAATTGCCTGTGTCTT | 72 | 4133 |
| 1208976 | N/A | N/A | 2323 | 2338 | TTTGCTAGTTCAATGT | 62 | 4134 |
| 1209001 | N/A | N/A | 2339 | 2354 | CAGGAACCTAATACTG | 61 | 4135 |
| 1209027 | N/A | N/A | 2442 | 2457 | GAATCAGCAACACATA | 85 | 4136 |
| 1209051 | N/A | N/A | 2465 | 2480 | AGTGCCATCAGCTTAG | 111 | 4137 |
| 1209077 | N/A | N/A | 2496 | 2511 | GTGTTAGACACTTGAT | 76 | 4138 |
| 1209104 | N/A | N/A | 2551 | 2566 | GCTGAAGAGCTGTGTA | 74 | 4139 |

TABLE 65-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209130 | N/A | N/A | 2649 | 2664 | TTGAATGAGTGTCCTT | 102 | 4140 |
| 1209156 | N/A | N/A | 2710 | 2725 | CACATTCCCAGTTAAG | 100 | 4141 |
| 1209184 | N/A | N/A | 2774 | 2789 | CAAGTCAATACTTGAA | 50 | 4142 |
| 1209209 | N/A | N/A | 2803 | 2818 | CCTACTTGCTGAATTT | 96 | 4143 |
| 1209234 | N/A | N/A | 2819 | 2834 | CTACATTGAGAATGTG | 55 | 4144 |
| 1209257 | N/A | N/A | 2902 | 2917 | AACCACTCTGATCTGA | 68 | 4145 |
| 1209281 | N/A | N/A | 2964 | 2979 | GGAAGAGCACTTGCCA | 79 | 4146 |
| 1209307 | N/A | N/A | 3029 | 3044 | GTAGACTCCTGACTCC | 79 | 4147 |
| 1209333 | N/A | N/A | 3374 | 3389 | CTCTAAAAGTTGGGTT | 55 | 4148 |
| 1209349 | N/A | N/A | 3461 | 3476 | TCAACTGCTCAGGCAC | 73 | 4149 |
| 1209362 | N/A | N/A | 3491 | 3506 | CAACACACTCTCTGAG | 69 | 4150 |
| 1209375 | N/A | N/A | 3606 | 3621 | TCTTACCAGGGCTGAG | 90 | 4151 |
| 1209388 | N/A | N/A | 3669 | 3684 | CTTGGACAGAAGGACA | 93 | 4152 |
| 1209401 | N/A | N/A | 3706 | 3721 | CTGCCCTATCACAGTC | 65 | 4153 |
| 1209414 | N/A | N/A | 3887 | 3902 | AGGAGAGTAATGAGGC | 80 | 4154 |
| 1209427 | N/A | N/A | 3950 | 3965 | GTATTGTGGAGGGAGA | 70 | 4155 |
| 1209440 | N/A | N/A | 4003 | 4018 | CCTGCAAAATGGGACC | 69 | 4156 |
| 1209453 | N/A | N/A | 4037 | 4052 | TTGCTACTCCAAGTTT | 69 | 4157 |
| 1209466 | N/A | N/A | 4070 | 4085 | AAGGCCCTTCTTGAAC | 62 | 4158 |
| 1209479 | N/A | N/A | 4272 | 4287 | AGCACCCCGCCCAGGT | 73 | 4159 |
| 1209492 | N/A | N/A | 4335 | 4350 | CCATGCCAAGTCTCCG | 87 | 4160 |
| 1209505 | N/A | N/A | 4369 | 4384 | CAAAGAGGGATAGTGG | 92 | 4161 |
| 1209518 | N/A | N/A | 4623 | 4638 | ACCCCTGGGCCTAAAG | 91 | 4162 |
| 1209531 | N/A | N/A | 4806 | 4821 | CAAGCCCGTCCCACCT | 52 | 4163 |
| 1209544 | N/A | N/A | 5151 | 5166 | TTCCTGTAGCCACACG | 50 | 4164 |
| 1209557 | N/A | N/A | 5432 | 5447 | CGGCTGGCCGGAATCT | 46 | 4165 |
| 1209570 | N/A | N/A | 5747 | 5762 | GGAGCCGCGGCCCCTG | 62 | 4166 |
| 1209583 | N/A | N/A | 5876 | 5891 | CTCCCGAACCCCAATC | 52 | 4167 |
| 1209596 | N/A | N/A | 6114 | 6129 | CTCTTCCCGTCCCCGC | 53 | 4168 |
| 1209609 | N/A | N/A | 6362 | 6377 | ACCCAGTGATCAAAGG | 40 | 4169 |
| 1209622 | N/A | N/A | 6440 | 6455 | CTCACAACCCATCAGG | 42 | 4170 |
| 1209635 | N/A | N/A | 6477 | 6492 | AGGCCCTGGGATTCTA | 39 | 4171 |
| 1209648 | N/A | N/A | 6544 | 6559 | GGAACCAAGAGCAAGT | 40 | 4172 |
| 1209661 | N/A | N/A | 6632 | 6647 | CCATCCAGAGTCGCAG | 38 | 4173 |
| 1209674 | N/A | N/A | 6712 | 6727 | CATAGGCAAGGAGGCT | 34 | 4174 |
| 1209687 | N/A | N/A | 6799 | 6814 | AAGCTGCTCCAGGCGC | 57 | 4175 |

TABLE 65-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209700 | N/A | N/A | 6849 | 6864 | CGCCTTCTTCACACCC | 117 | 4176 |
| 1209713 | N/A | N/A | 7059 | 7074 | GTGCCTGACGGCCTCG | 68† | 4177 |

TABLE 66

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128802 | 218 | 233 | 3569 | 3584 | TACATTTGTGGTACAG | 99 | 2426 |
| 1129531 | 2009 | 2024 | 7397 | 7412 | GAGTTCCTGCGCCATC | 16 | 3837 |
| 1129947 | N/A | N/A | 4837 | 4852 | TGCTTTCCGCACTCTC | 51 | 3554 |
| 1129948 | N/A | N/A | 4840 | 4855 | ATCTGCTTTCCGCACT | 70 | 3630 |
| 1208266 | N/A | N/A | 98 | 113 | CACTCACCGAAAGTGT | 65 | 4178 |
| 1208297 | N/A | N/A | 136 | 151 | CCCCCAGAACAATCCT | 84 | 4179 |
| 1208332 | N/A | N/A | 205 | 220 | ATAGGCCTCCTAGTCA | 97 | 4180 |
| 1208366 | N/A | N/A | 275 | 290 | CCTTGTATCCACCCAG | 55 | 4181 |
| 1208397 | N/A | N/A | 322 | 337 | CCCGTTGTCTTCTTAA | 87 | 4182 |
| 1208431 | N/A | N/A | 417 | 432 | TAGCCTGCCACCGATC | 78 | 4183 |
| 1208459 | N/A | N/A | 462 | 477 | GAATCTACAAGGGAGA | 52 | 4184 |
| 1208492 | N/A | N/A | 556 | 571 | CCACCCAAGGGTTCCC | 81 | 4185 |
| 1208516 | N/A | N/A | 609 | 624 | TAGGCACTAGACTAGA | 97 | 4186 |
| 1208549 | N/A | N/A | 635 | 650 | CCATGGGCATAAGACC | 38 | 4187 |
| 1208578 | N/A | N/A | 674 | 689 | TGCCCTCAAGGATCAC | 46 | 4188 |
| 1208591 | N/A | N/A | 740 | 755 | AGCAGCACATATCTCA | 95 | 4189 |
| 1208604 | N/A | N/A | 863 | 878 | ATTGAAGGCCCTGGCC | 47 | 4190 |
| 1208617 | N/A | N/A | 896 | 911 | TGCCAGAGACAAGCTC | 43 | 4191 |
| 1208630 | N/A | N/A | 934 | 949 | CTCATAAGTGATAAAG | 58 | 4192 |
| 1208643 | N/A | N/A | 977 | 992 | TTGAAGCTTGGAGAAC | 52 | 4193 |
| 1208656 | N/A | N/A | 1019 | 1034 | AAGAGGTTTACTGTTA | 76 | 4194 |
| 1208669 | N/A | N/A | 1063 | 1078 | GATGGGCTGAATACCT | 51 | 4195 |
| 1208682 | N/A | N/A | 1130 | 1145 | ACCCTTCATCTAAAAG | 56 | 4196 |
| 1208695 | N/A | N/A | 1168 | 1183 | AGCTATGGCAGAGCTT | 98 | 4197 |
| 1208708 | N/A | N/A | 1520 | 1535 | CCACACTCTAGGTAAA | 44 | 4198 |
| 1208721 | N/A | N/A | 1575 | 1590 | ACCAAGTCAGGCCCAC | 92 | 4199 |

TABLE 66-continued

Reduction of FXII RNA by 3-10-3 cEt gapmers with
uniform PS internucleoside linkages (Huh7,
electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1208742 | N/A | N/A | 1620 | 1635 | TTGGAATGTGCTGGGC | 58 | 4200 |
| 1208768 | N/A | N/A | 1693 | 1708 | AGTTTGGGTAAGGCAA | 62 | 4201 |
| 1208796 | N/A | N/A | 1759 | 1774 | AGATGGGATGGACGGA | 47 | 4202 |
| 1208820 | N/A | N/A | 1924 | 1939 | TAGCTGAGCATGAAGT | 43 | 4203 |
| 1208847 | N/A | N/A | 2113 | 2128 | ACTAGGACAGTAAATG | 50 | 4204 |
| 1208874 | N/A | N/A | 2130 | 2145 | CCAAGGACCAAACCAG | 67 | 4205 |
| 1208899 | N/A | N/A | 2169 | 2184 | AGCTTTTGCCACTATT | 90 | 4206 |
| 1208925 | N/A | N/A | 2191 | 2206 | GGCACAAAGTACCTGC | 71 | 4207 |
| 1208951 | N/A | N/A | 2269 | 2284 | GAGAATTGCCTGTGTC | 92 | 4208 |
| 1208977 | N/A | N/A | 2325 | 2340 | TGTTTGCTAGTTCAAT | 27 | 4209 |
| 1209004 | N/A | N/A | 2340 | 2355 | ACAGGAACCTAATACT | 74 | 4210 |
| 1209028 | N/A | N/A | 2446 | 2461 | TGATGAATCAGCAACA | 59 | 4211 |
| 1209053 | N/A | N/A | 2467 | 2482 | ATAGTGCCATCAGCTT | 50 | 4212 |
| 1209080 | N/A | N/A | 2498 | 2513 | GTGTGTTAGACACTTG | 50 | 4213 |
| 1209105 | N/A | N/A | 2570 | 2585 | AATGGCCTCTGAGCCT | 46 | 4214 |
| 1209131 | N/A | N/A | 2650 | 2665 | ATTGAATGAGTGTCCT | 117 | 4215 |
| 1209159 | N/A | N/A | 2711 | 2726 | GCACATTCCCAGTTAA | 49 | 4216 |
| 1209187 | N/A | N/A | 2775 | 2790 | CCAAGTCAATACTTGA | 45 | 4217 |
| 1209210 | N/A | N/A | 2804 | 2819 | GCCTACTTGCTGAATT | 35 | 4218 |
| 1209236 | N/A | N/A | 2824 | 2839 | TGGTTCTACATTGAGA | 93 | 4219 |
| 1209258 | N/A | N/A | 2903 | 2918 | TAACCACTCTGATCTG | 49 | 4220 |
| 1209284 | N/A | N/A | 2965 | 2980 | AGGAAGAGCACTTGCC | 55 | 4221 |
| 1209309 | N/A | N/A | 3030 | 3045 | AGTAGACTCCTGACTC | 49 | 4222 |
| 1209336 | N/A | N/A | 3377 | 3392 | CTGCTCTAAAAGTTGG | 64 | 4223 |
| 1209350 | N/A | N/A | 3462 | 3477 | CTCAACTGCTCAGGCA | 61 | 4224 |
| 1209363 | N/A | N/A | 3492 | 3507 | ACAACACACTCTCTGA | 48 | 4225 |
| 1209376 | N/A | N/A | 3607 | 3622 | GTCTTACCAGGGCTGA | 59 | 4226 |
| 1209389 | N/A | N/A | 3670 | 3685 | CCTTGGACAGAAGGAC | 49 | 4227 |
| 1209402 | N/A | N/A | 3707 | 3722 | CCTGCCCTATCACAGT | 92 | 4228 |
| 1209415 | N/A | N/A | 3889 | 3904 | CCAGGAGAGTAATGAG | 49 | 4229 |
| 1209428 | N/A | N/A | 3951 | 3966 | GGTATTGTGGAGGGAG | 56 | 4230 |
| 1209441 | N/A | N/A | 4012 | 4027 | GTTTACCCACCTGCAA | 39 | 4231 |
| 1209454 | N/A | N/A | 4038 | 4053 | CTTGCTACTCCAAGTT | 108 | 4232 |
| 1209467 | N/A | N/A | 4073 | 4088 | GCCAAGGCCCTTCTTG | 56 | 4233 |
| 1209480 | N/A | N/A | 4295 | 4310 | GCCCAGGGTTGCCCCT | 65 | 4234 |
| 1209493 | N/A | N/A | 4336 | 4351 | ACCATGCCAAGTCTCC | 46 | 4235 |

TABLE 66-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209506 | N/A | N/A | 4370 | 4385 | ACAAAGAGGGATAGTG | 67 | 4236 |
| 1209519 | N/A | N/A | 4625 | 4640 | CCACCCCTGGGCCTAA | 134 | 4237 |
| 1209532 | N/A | N/A | 4807 | 4822 | GCAAGCCCGTCCCACC | 81 | 4238 |
| 1209545 | N/A | N/A | 5152 | 5167 | GTTCCTGTAGCCACAC | 23 | 4239 |
| 1209558 | N/A | N/A | 5435 | 5450 | GGCCGGCTGGCCGGAA | 84 | 4240 |
| 1209571 | N/A | N/A | 5748 | 5763 | AGGAGCCGCGGCCCCT | 64 | 4241 |
| 1209584 | N/A | N/A | 5878 | 5893 | TGCTCCCGAACCCCAA | 35 | 4242 |
| 1209597 | N/A | N/A | 6120 | 6135 | CAAGCTCTCTTCCCGT | 53 | 4243 |
| 1209610 | N/A | N/A | 6365 | 6380 | CTAACCCAGTGATCAA | 29 | 4244 |
| 1209623 | N/A | N/A | 6443 | 6458 | ATTCTCACAACCCATC | 64 | 4245 |
| 1209636 | N/A | N/A | 6486 | 6501 | GTGAATCCCAGGCCCT | 41 | 4246 |
| 1209649 | N/A | N/A | 6553 | 6568 | CGCCCAGAGGGAACCA | 116 | 4247 |
| 1209662 | N/A | N/A | 6633 | 6648 | CCCATCCAGAGTCGCA | 30 | 4248 |
| 1209675 | N/A | N/A | 6713 | 6728 | TCATAGGCAAGGAGGC | 36 | 4249 |
| 1209688 | N/A | N/A | 6800 | 6815 | AAAGCTGCTCCAGGCG | 27 | 4250 |
| 1209701 | N/A | N/A | 6850 | 6865 | GCGCCTTCTTCACACC | 85 | 4251 |
| 1209714 | N/A | N/A | 7063 | 7078 | ATTTGTGCCTGACGGC | 53[†] | 4252 |

TABLE 67

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128802 | 218 | 233 | 3569 | 3584 | TACATTTGTGGTACAG | 29 | 2426 |
| 1129531 | 2009 | 2024 | 7397 | 7412 | GAGTTCCTGCGCCATC | 33 | 3837 |
| 1129948 | N/A | N/A | 4840 | 4855 | ATCTGCTTTCCGCACT | 52 | 3630 |
| 1194288 | N/A | N/A | 4838 | 4853 | CTGCTTTCCGCACTCT | 27 | 4253 |
| 1208267 | N/A | N/A | 104 | 119 | CCACAGCACTCACCGA | 128 | 4254 |
| 1208301 | N/A | N/A | 137 | 152 | CCCCCCAGAACAATCC | 177 | 4255 |
| 1208333 | N/A | N/A | 213 | 228 | CTTTCCACATAGGCCT | 68 | 4256 |
| 1208370 | N/A | N/A | 276 | 291 | CCCTTGTATCCACCCA | 41 | 4257 |
| 1208398 | N/A | N/A | 331 | 346 | CTACCTCCCCCCGTTG | 91 | 4258 |
| 1208432 | N/A | N/A | 418 | 433 | ATAGCCTGCCACCGAT | 116 | 4259 |
| 1208463 | N/A | N/A | 465 | 480 | GTGGAATCTACAAGGG | 34 | 4260 |

TABLE 67-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1208494 | N/A | N/A | 557 | 572 | CCCACCCAAGGGTTCC | 44 | 4261 |
| 1208519 | N/A | N/A | 616 | 631 | CACCAGGTAGGCACTA | 93 | 4262 |
| 1208550 | N/A | N/A | 638 | 653 | TGCCCATGGGCATAAG | 43 | 4263 |
| 1208579 | N/A | N/A | 685 | 700 | AGCCCATACCCTGCCC | 77 | 4264 |
| 1208592 | N/A | N/A | 741 | 756 | CAGCAGCACATATCTC | 64 | 4265 |
| 1208605 | N/A | N/A | 864 | 879 | CATTGAAGGCCCTGGC | 90 | 4266 |
| 1208618 | N/A | N/A | 897 | 912 | ATGCCAGAGACAAGCT | 56 | 4267 |
| 1208631 | N/A | N/A | 935 | 950 | GCTCATAAGTGATAAA | 54 | 4268 |
| 1208644 | N/A | N/A | 1002 | 1017 | CAACCTGGTTTCACAG | 32 | 4269 |
| 1208657 | N/A | N/A | 1020 | 1035 | TAAGAGGTTTACTGTT | 44 | 4270 |
| 1208670 | N/A | N/A | 1066 | 1081 | GGTGATGGGCTGAATA | 52 | 4271 |
| 1208683 | N/A | N/A | 1131 | 1146 | TACCCTTCATCTAAAA | 80 | 4272 |
| 1208696 | N/A | N/A | 1169 | 1184 | GAGCTATGGCAGAGCT | 67 | 4273 |
| 1208709 | N/A | N/A | 1529 | 1544 | TGCTATGTGCCACACT | 61 | 4274 |
| 1208722 | N/A | N/A | 1578 | 1593 | CCCACCAAGTCAGGCC | 56 | 4275 |
| 1208744 | N/A | N/A | 1621 | 1636 | GTTGGAATGTGCTGGG | 42 | 4276 |
| 1208771 | N/A | N/A | 1694 | 1709 | AAGTTTGGGTAAGGCA | 81 | 4277 |
| 1208799 | N/A | N/A | 1760 | 1775 | CAGATGGGATGGACGG | 57 | 4278 |
| 1208821 | N/A | N/A | 2075 | 2090 | TTAAGATGCAAATGGG | 31 | 4279 |
| 1208848 | N/A | N/A | 2115 | 2130 | GAACTAGGACAGTAAA | 40 | 4280 |
| 1208877 | N/A | N/A | 2131 | 2146 | GCCAAGGACCAAACCA | 34 | 4281 |
| 1208901 | N/A | N/A | 2170 | 2185 | AAGCTTTTGCCACTAT | 49 | 4282 |
| 1208926 | N/A | N/A | 2192 | 2207 | TGGCACAAAGTACCTG | 73 | 4283 |
| 1208952 | N/A | N/A | 2270 | 2285 | TGAGAATTGCCTGTGT | 59 | 4284 |
| 1208980 | N/A | N/A | 2326 | 2341 | CTGTTTGCTAGTTCAA | 47 | 4285 |
| 1209005 | N/A | N/A | 2342 | 2357 | TCACAGGAACCTAATA | 101 | 4286 |
| 1209031 | N/A | N/A | 2447 | 2462 | TTGATGAATCAGCAAC | 39 | 4287 |
| 1209054 | N/A | N/A | 2471 | 2486 | TGCTATAGTGCCATCA | 49 | 4288 |
| 1209081 | N/A | N/A | 2517 | 2532 | GCTACCTTAGGGAGAA | 48 | 4289 |
| 1209108 | N/A | N/A | 2572 | 2587 | GAAATGGCCTCTGAGC | 30 | 4290 |
| 1209134 | N/A | N/A | 2657 | 2672 | CTCTCCTATTGAATGA | 18 | 4291 |
| 1209160 | N/A | N/A | 2713 | 2728 | TTGCACATTCCCAGTT | 34 | 4292 |
| 1209188 | N/A | N/A | 2776 | 2791 | CCCAAGTCAATACTTG | 43 | 4293 |
| 1209212 | N/A | N/A | 2805 | 2820 | TGCCTACTTGCTGAAT | 87 | 4294 |
| 1209238 | N/A | N/A | 2825 | 2840 | CTGGTTCTACATTGAG | 20 | 4295 |
| 1209261 | N/A | N/A | 2905 | 2920 | GTTAACCACTCTGATC | 79 | 4296 |

TABLE 67-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209285 | N/A | N/A | 2985 | 3000 | AAGTCTTCAGTCCCAA | 47 | 4297 |
| 1209312 | N/A | N/A | 3033 | 3048 | TGGAGTAGACTCCTGA | 72 | 4298 |
| 1209337 | N/A | N/A | 3413 | 3428 | ACCCTCAAAAAGGTCG | 45 | 4299 |
| 1209351 | N/A | N/A | 3463 | 3478 | ACTCAACTGCTCAGGC | 87 | 4300 |
| 1209364 | N/A | N/A | 3493 | 3508 | GACAACACACTCTCTG | 44 | 4301 |
| 1209377 | N/A | N/A | 3608 | 3623 | AGTCTTACCAGGGCTG | 88 | 4302 |
| 1209390 | N/A | N/A | 3673 | 3688 | GTTCCTTGGACAGAAG | 96 | 4303 |
| 1209403 | N/A | N/A | 3709 | 3724 | ACCCTGCCCTATCACA | 29 | 4304 |
| 1209416 | N/A | N/A | 3890 | 3905 | ACCAGGAGAGTAATGA | 31 | 4305 |
| 1209429 | N/A | N/A | 3954 | 3969 | AAGGGTATTGTGGAGG | 45 | 4306 |
| 1209442 | N/A | N/A | 4016 | 4031 | CTTGGTTTACCCACCT | 49 | 4307 |
| 1209455 | N/A | N/A | 4041 | 4056 | GACCTTGCTACTCCAA | 21 | 4308 |
| 1209468 | N/A | N/A | 4074 | 4089 | GGCCAAGGCCCTTCTT | 128 | 4309 |
| 1209481 | N/A | N/A | 4298 | 4313 | TAGGCCCAGGGTTGCC | 135 | 4310 |
| 1209494 | N/A | N/A | 4337 | 4352 | GACCATGCCAAGTCTC | 40 | 4311 |
| 1209507 | N/A | N/A | 4528 | 4543 | GTTCCCAACCATCTGC | 42 | 4312 |
| 1209520 | N/A | N/A | 4631 | 4646 | AGTGAGCCACCCCTGG | 91 | 4313 |
| 1209533 | N/A | N/A | 4813 | 4828 | TTCCTGGCAAGCCCGT | 60 | 4314 |
| 1209546 | N/A | N/A | 5156 | 5171 | CCGGGTTCCTGTAGCC | 58 | 4315 |
| 1209559 | N/A | N/A | 5437 | 5452 | GCGGCCGGCTGGCCGG | 56 | 4316 |
| 1209572 | N/A | N/A | 5749 | 5764 | GAGGAGCCGCGGCCCC | 40 | 4317 |
| 1209585 | N/A | N/A | 5879 | 5894 | CTGCTCCCGAACCCCA | 48 | 4318 |
| 1209598 | N/A | N/A | 6121 | 6136 | CCAAGCTCTCTTCCCG | 61 | 4319 |
| 1209611 | N/A | N/A | 6366 | 6381 | CCTAACCCAGTGATCA | 48 | 4320 |
| 1209624 | N/A | N/A | 6453 | 6468 | TCACCTACACATTCTC | 37 | 4321 |
| 1209637 | N/A | N/A | 6487 | 6502 | AGTGAATCCCAGGCCC | 138 | 4322 |
| 1209650 | N/A | N/A | 6554 | 6569 | GCGCCCAGAGGGAACC | 50 | 4323 |
| 1209663 | N/A | N/A | 6635 | 6650 | CACCCATCCAGAGTCG | 51 | 4324 |
| 1209676 | N/A | N/A | 6714 | 6729 | TTCATAGGCAAGGAGG | 45 | 4325 |
| 1209689 | N/A | N/A | 6803 | 6818 | GACAAAGCTGCTCCAG | 99 | 4326 |
| 1209702 | N/A | N/A | 6864 | 6879 | CCTGCGAACACAGAGC | 43 | 4327 |
| 1209715 | N/A | N/A | 7067 | 7082 | TGAGATTTGTGCCTGA | 44[†] | 4328 |

TABLE 68

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128802 | 218 | 233 | 3569 | 3584 | TACATTTGTGGTACAG | 37 | 2426 |
| 1129531 | 2009 | 2024 | 7397 | 7412 | GAGTTCCTGCGCCATC | 25 | 3837 |
| 1129948 | N/A | N/A | 4840 | 4855 | ATCTGCTTTCCGCACT | 44 | 3630 |
| 1194289 | N/A | N/A | 4839 | 4854 | TCTGCTTTCCGCACTC | 28 | 4329 |
| 1208271 | N/A | N/A | 116 | 131 | CAATCCTGGTTCCCAC | 68 | 4330 |
| 1208302 | N/A | N/A | 154 | 169 | CATGGCTGTGATAGCG | 73 | 4331 |
| 1208337 | N/A | N/A | 215 | 230 | ACCTTTCCACATAGGC | 81 | 4332 |
| 1208371 | N/A | N/A | 278 | 293 | TGCCCTTGTATCCACC | 43 | 4333 |
| 1208402 | N/A | N/A | 342 | 357 | CCAAACCCTTTCTACC | 59 | 4334 |
| 1208435 | N/A | N/A | 419 | 434 | CATAGCCTGCCACCGA | 29 | 4335 |
| 1208464 | N/A | N/A | 467 | 482 | AGGTGGAATCTACAAG | 38 | 4336 |
| 1208497 | N/A | N/A | 558 | 573 | CCCCACCCAAGGGTTC | 68 | 4337 |
| 1208520 | N/A | N/A | 617 | 632 | GCACCAGGTAGGCACT | 44 | 4338 |
| 1208554 | N/A | N/A | 646 | 661 | CACTCTAGTGCCCATG | 111 | 4339 |
| 1208580 | N/A | N/A | 695 | 710 | ACTTAGACACAGCCCA | 43 | 4340 |
| 1208593 | N/A | N/A | 745 | 760 | GCGCCAGCAGCACATA | 55 | 4341 |
| 1208606 | N/A | N/A | 865 | 880 | CCATTGAAGGCCCTGG | 39 | 4342 |
| 1208619 | N/A | N/A | 898 | 913 | GATGCCAGAGACAAGC | 26 | 4343 |
| 1208632 | N/A | N/A | 936 | 951 | AGCTCATAAGTGATAA | 73 | 4344 |
| 1208645 | N/A | N/A | 1005 | 1020 | TATCAACCTGGTTTCA | 47 | 4345 |
| 1208658 | N/A | N/A | 1021 | 1036 | CTAAGAGGTTTACTGT | 35 | 4346 |
| 1208671 | N/A | N/A | 1072 | 1087 | GCACCAGGTGATGGGC | 40 | 4347 |
| 1208684 | N/A | N/A | 1133 | 1148 | GGTACCCTTCATCTAA | 121 | 4348 |
| 1208697 | N/A | N/A | 1200 | 1215 | ATTTAGTGTCTGGAAG | 41 | 4349 |
| 1208710 | N/A | N/A | 1541 | 1556 | GTTCACAGGCCCTGCT | 55 | 4350 |
| 1208723 | N/A | N/A | 1579 | 1594 | CCCCACCAAGTCAGGC | 95 | 4351 |
| 1208745 | N/A | N/A | 1624 | 1639 | AGGGTTGGAATGTGCT | 44 | 4352 |
| 1208773 | N/A | N/A | 1697 | 1712 | ACCAAGTTTGGGTAAG | 39 | 4353 |
| 1208800 | N/A | N/A | 1762 | 1777 | TGCAGATGGGATGGAC | 51 | 4354 |
| 1208824 | N/A | N/A | 2080 | 2095 | GACCTTTAAGATGCAA | 40 | 4355 |
| 1208851 | N/A | N/A | 2116 | 2131 | AGAACTAGGACAGTAA | 33 | 4356 |
| 1208878 | N/A | N/A | 2133 | 2148 | TTGCCAAGGACCAAAC | 36 | 4357 |
| 1208902 | N/A | N/A | 2171 | 2186 | TAAGCTTTTGCCACTA | 29 | 4358 |
| 1208929 | N/A | N/A | 2193 | 2208 | CTGGCACAAAGTACCT | 58 | 4359 |
| 1208955 | N/A | N/A | 2271 | 2286 | ATGAGAATTGCCTGTG | 29 | 4360 |
| 1208981 | N/A | N/A | 2327 | 2342 | ACTGTTTGCTAGTTCA | 44 | 4361 |

TABLE 68-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209008 | N/A | N/A | 2375 | 2390 | CTGTTGGTTGATGAAA | 83 | 4362 |
| 1209032 | N/A | N/A | 2448 | 2463 | ATTGATGAATCAGCAA | 68 | 4363 |
| 1209057 | N/A | N/A | 2472 | 2487 | GTGCTATAGTGCCATC | 25 | 4364 |
| 1209084 | N/A | N/A | 2518 | 2533 | GGCTACCTTAGGGAGA | 57 | 4365 |
| 1209109 | N/A | N/A | 2579 | 2594 | GCTTTTGGAAATGGCC | 27 | 4366 |
| 1209135 | N/A | N/A | 2673 | 2688 | CTGCTGCTTGTTTCAG | 82 | 4367 |
| 1209163 | N/A | N/A | 2716 | 2731 | AATTTGCACATTCCCA | 71 | 4368 |
| 1209191 | N/A | N/A | 2777 | 2792 | TCCCAAGTCAATACTT | 77 | 4369 |
| 1209213 | N/A | N/A | 2808 | 2823 | ATGTGCCTACTTGCTG | 58 | 4370 |
| 1209240 | N/A | N/A | 2827 | 2842 | CTCTGGTTCTACATTG | 38 | 4371 |
| 1209262 | N/A | N/A | 2906 | 2921 | TGTTAACCACTCTGAT | 106 | 4372 |
| 1209288 | N/A | N/A | 2986 | 3001 | TAAGTCTTCAGTCCCA | 33 | 4373 |
| 1209313 | N/A | N/A | 3042 | 3057 | TCAGATAGCTGGAGTA | 82 | 4374 |
| 1209339 | N/A | N/A | 3414 | 3429 | GACCCTCAAAAAGGTC | 76 | 4375 |
| 1209352 | N/A | N/A | 3464 | 3479 | TACTCAACTGCTCAGG | 47 | 4376 |
| 1209365 | N/A | N/A | 3494 | 3509 | GGACAACACACTCTCT | 73 | 4377 |
| 1209378 | N/A | N/A | 3611 | 3626 | CGTAGTCTTACCAGGG | 27 | 4378 |
| 1209391 | N/A | N/A | 3678 | 3693 | GCAGAGTTCCTTGGAC | 22 | 4379 |
| 1209404 | N/A | N/A | 3713 | 3728 | GCCCACCCTGCCCTAT | 83 | 4380 |
| 1209417 | N/A | N/A | 3891 | 3906 | TACCAGGAGAGTAATG | 34 | 4381 |
| 1209430 | N/A | N/A | 3955 | 3970 | AAAGGGTATTGTGGAG | 19 | 4382 |
| 1209443 | N/A | N/A | 4020 | 4035 | CAAGCTTGGTTTACCC | 48 | 4383 |
| 1209456 | N/A | N/A | 4053 | 4068 | TACTTGCCTTGTGACC | 42 | 4384 |
| 1209469 | N/A | N/A | 4075 | 4090 | GGGCCAAGGCCCTTCT | 51 | 4385 |
| 1209482 | N/A | N/A | 4299 | 4314 | GTAGGCCCAGGGTTGC | 33 | 4386 |
| 1209495 | N/A | N/A | 4340 | 4355 | TAGGACCATGCCAAGT | 39 | 4387 |
| 1209508 | N/A | N/A | 4530 | 4545 | CCGTTCCCAACCATCT | 60 | 4388 |
| 1209521 | N/A | N/A | 4638 | 4653 | GGAACGCAGTGAGCCA | 73 | 4389 |
| 1209534 | N/A | N/A | 4814 | 4829 | CTTCCTGGCAAGCCCG | 45 | 4390 |
| 1209547 | N/A | N/A | 5161 | 5176 | GTTGTCCGGGTTCCTG | 39 | 4391 |
| 1209560 | N/A | N/A | 5439 | 5454 | CCGCGGCCGGCTGGCC | 42 | 4392 |
| 1209573 | N/A | N/A | 5756 | 5771 | GGAGACGGAGGAGCCG | 71 | 4393 |
| 1209586 | N/A | N/A | 5885 | 5900 | AGCCCCTGCTCCCGA | 50 | 4394 |
| 1209599 | N/A | N/A | 6126 | 6141 | GGGCCCAAGCTCTCT | 30 | 4395 |
| 1209612 | N/A | N/A | 6372 | 6387 | CTTCCGCCTAACCCAG | 36 | 4396 |

TABLE 68-continued

Reduction of FXII RNA by 3-10-3 cEt gapmers with
uniform PS internucleoside linkages (Huh7,
electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209625 | N/A | N/A | 6456 | 6471 | GATTCACCTACACATT | 40 | 4397 |
| 1209638 | N/A | N/A | 6490 | 6505 | AGCAGTGAATCCCAGG | 35 | 4398 |
| 1209651 | N/A | N/A | 6569 | 6584 | GGCCTTTGCAGCCCGG | 58 | 4399 |
| 1209664 | N/A | N/A | 6636 | 6651 | CCACCCATCCAGAGTC | 73 | 4400 |
| 1209677 | N/A | N/A | 6730 | 6745 | GTGCCATTAATTCAAT | 61 | 4401 |
| 1209690 | N/A | N/A | 6804 | 6819 | GGACAAAGCTGCTCCA | 75 | 4402 |
| 1209703 | N/A | N/A | 6868 | 6883 | CGCCCCTGCGAACACA | 27 | 4403 |
| 1209716 | N/A | N/A | 7068 | 7083 | CTGAGATTTGTGCCTG | 25† | 4404 |

TABLE 69

Reduction of FXII RNA by 3-10-3 cEt gapmers with
uniform PS internucleoside linkages (Huh7,
electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128802 | 218 | 233 | 3569 | 3584 | TACATTTGTGGTACAG | 98 | 2426 |
| 1129531 | 2009 | 2024 | 7397 | 7412 | GAGTTCCTGCGCCATC | 13 | 3837 |
| 1129948 | N/A | N/A | 4840 | 4855 | ATCTGCTTTCCGCACT | 71 | 3630 |
| 1194290 | N/A | N/A | 4841 | 4856 | CATCTGCTTTCCGCAC | 44 | 4405 |
| 1208272 | N/A | N/A | 117 | 132 | ACAATCCTGGTTCCCA | 40 | 4406 |
| 1208307 | N/A | N/A | 177 | 192 | GGTCATGAGCAGAGGC | 58 | 4407 |
| 1208338 | N/A | N/A | 217 | 232 | TCACCTTTCCACATAG | 59 | 4408 |
| 1208375 | N/A | N/A | 301 | 316 | ATCTCCCCCAGAAATG | 40 | 4409 |
| 1208403 | N/A | N/A | 343 | 358 | CCCAAACCCTTTCTAC | 86 | 4410 |
| 1208436 | N/A | N/A | 421 | 436 | GTCATAGCCTGCCACC | 72 | 4411 |
| 1208468 | N/A | N/A | 468 | 483 | AAGGTGGAATCTACAA | 47 | 4412 |
| 1208498 | N/A | N/A | 560 | 575 | ATCCCCACCCAAGGGT | 53 | 4413 |
| 1208524 | N/A | N/A | 618 | 633 | AGCACCAGGTAGGCAC | 49 | 4414 |
| 1208555 | N/A | N/A | 648 | 663 | ATCACTCTAGTGCCCA | 111 | 4415 |
| 1208581 | N/A | N/A | 696 | 711 | CACTTAGACACAGCCC | 83 | 4416 |
| 1208594 | N/A | N/A | 834 | 849 | AATGATGCCCATGAGA | 40 | 4417 |
| 1208607 | N/A | N/A | 868 | 883 | TGCCCATTGAAGGCCC | 60 | 4418 |
| 1208620 | N/A | N/A | 906 | 921 | GGCATTCAGATGCCAG | 108 | 4419 |
| 1208633 | N/A | N/A | 937 | 952 | CAGCTCATAAGTGATA | 55 | 4420 |
| 1208646 | N/A | N/A | 1006 | 1021 | TTATCAACCTGGTTTC | 57 | 4421 |
| 1208659 | N/A | N/A | 1025 | 1040 | AACCCTAAGAGGTTTA | 40 | 4422 |

TABLE 69-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1208672 | N/A | N/A | 1073 | 1088 | TGCACCAGGTGATGGG | 53 | 4423 |
| 1208685 | N/A | N/A | 1135 | 1150 | CAGGTACCCTTCATCT | 51 | 4424 |
| 1208698 | N/A | N/A | 1202 | 1217 | TAATTTAGTGTCTGGA | 89 | 4425 |
| 1208711 | N/A | N/A | 1547 | 1562 | CATCTGGTTCACAGGC | 53 | 4426 |
| 1208724 | N/A | N/A | 1580 | 1595 | ACCCCACCAAGTCAGG | 106 | 4427 |
| 1208748 | N/A | N/A | 1625 | 1640 | CAGGGTTGGAATGTGC | 88 | 4428 |
| 1208775 | N/A | N/A | 1698 | 1713 | CACCAAGTTTGGGTAA | 93 | 4429 |
| 1208802 | N/A | N/A | 1763 | 1778 | ATGCAGATGGGATGGA | 41 | 4430 |
| 1208825 | N/A | N/A | 2081 | 2096 | GGACCTTTAAGATGCA | 44 | 4431 |
| 1208852 | N/A | N/A | 2117 | 2132 | CAGAACTAGGACAGTA | 90 | 4432 |
| 1208881 | N/A | N/A | 2134 | 2149 | CTTGCCAAGGACCAAA | 84 | 4433 |
| 1208905 | N/A | N/A | 2172 | 2187 | ATAAGCTTTTGCCACT | 66 | 4434 |
| 1208930 | N/A | N/A | 2207 | 2222 | ATGCTGAGCAGTGTCT | 30 | 4435 |
| 1208956 | N/A | N/A | 2277 | 2292 | CGAATAATGAGAATTG | 73 | 4436 |
| 1208984 | N/A | N/A | 2328 | 2343 | TACTGTTTGCTAGTTC | 81 | 4437 |
| 1209009 | N/A | N/A | 2378 | 2393 | ATGCTGTTGGTTGATG | 39 | 4438 |
| 1209035 | N/A | N/A | 2451 | 2466 | AGCATTGATGAATCAG | 117 | 4439 |
| 1209058 | N/A | N/A | 2473 | 2488 | TGTGCTATAGTGCCAT | 111 | 4440 |
| 1209085 | N/A | N/A | 2522 | 2537 | AGAAGGCTACCTTAGG | 79 | 4441 |
| 1209111 | N/A | N/A | 2580 | 2595 | GGCTTTTGGAAATGGC | 62 | 4442 |
| 1209137 | N/A | N/A | 2698 | 2713 | TAAGGTTCAACAAGGC | 44 | 4443 |
| 1209166 | N/A | N/A | 2717 | 2732 | AAATTTGCACATTCCC | 86 | 4444 |
| 1209192 | N/A | N/A | 2778 | 2793 | CTCCCAAGTCAATACT | 105 | 4445 |
| 1209215 | N/A | N/A | 2810 | 2825 | GAATGTGCCTACTTGC | 42 | 4446 |
| 1209241 | N/A | N/A | 2851 | 2866 | ATAGTACAGTTGATCC | 40 | 4447 |
| 1209265 | N/A | N/A | 2908 | 2923 | ACTGTTAACCACTCTG | 57 | 4448 |
| 1209289 | N/A | N/A | 2988 | 3003 | GGTAAGTCTTCAGTCC | 46 | 4449 |
| 1209316 | N/A | N/A | 3043 | 3058 | GTCAGATAGCTGGAGT | 94 | 4450 |
| 1209340 | N/A | N/A | 3415 | 3430 | AGACCCTCAAAAAGGT | 40 | 4451 |
| 1209353 | N/A | N/A | 3465 | 3480 | GTACTCAACTGCTCAG | 57 | 4452 |
| 1209366 | N/A | N/A | 3496 | 3511 | AGGGACAACACACTCT | 35 | 4453 |
| 1209379 | N/A | N/A | 3625 | 3640 | CTCCAACTCCTCTGCG | 61 | 4454 |
| 1209392 | N/A | N/A | 3681 | 3696 | CAAGCAGAGTTCCTTG | 62 | 4455 |
| 1209405 | N/A | N/A | 3745 | 3760 | GACAAGGCTTCCCTGC | 106 | 4456 |
| 1209418 | N/A | N/A | 3892 | 3907 | ATACCAGGAGAGTAAT | 51 | 4457 |

TABLE 69-continued

Reduction of FXII RNA by 3-10-3 cEt gapmers with
uniform PS internucleoside linkages (Huh7,
electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209431 | N/A | N/A | 3959 | 3974 | TTCCAAAGGGTATTGT | 41 | 4458 |
| 1209444 | N/A | N/A | 4021 | 4036 | CCAAGCTTGGTTTACC | 90 | 4459 |
| 1209457 | N/A | N/A | 4054 | 4069 | CTACTTGCCTTGTGAC | 42 | 4460 |
| 1209470 | N/A | N/A | 4126 | 4141 | GAGAGATGGACATGGT | 44 | 4461 |
| 1209483 | N/A | N/A | 4301 | 4316 | CTGTAGGCCCAGGGTT | 44 | 4462 |
| 1209496 | N/A | N/A | 4341 | 4356 | CTAGGACCATGCCAAG | 84 | 4463 |
| 1209509 | N/A | N/A | 4531 | 4546 | CCCGTTCCCAACCATC | 114 | 4464 |
| 1209522 | N/A | N/A | 4640 | 4655 | AGGGAACGCAGTGAGC | 74 | 4465 |
| 1209535 | N/A | N/A | 4833 | 4848 | TTCCGCACTCTCCCTC | 81 | 4466 |
| 1209548 | N/A | N/A | 5162 | 5177 | CGTTGTCCGGGTTCCT | 11 | 4467 |
| 1209561 | N/A | N/A | 5441 | 5456 | GCCCGCGGCCGGCTGG | 39 | 4468 |
| 1209574 | N/A | N/A | 5757 | 5772 | GGGAGACGGAGGAGCC | 76 | 4469 |
| 1209587 | N/A | N/A | 5886 | 5901 | AAGCCCCTGCTCCCG | 99 | 4470 |
| 1209600 | N/A | N/A | 6173 | 6188 | GCAACAGAGCTAACCC | 52 | 4471 |
| 1209613 | N/A | N/A | 6374 | 6389 | TTCTTCCGCCTAACCC | 31 | 4472 |
| 1209626 | N/A | N/A | 6460 | 6475 | CTGGGATTCACCTACA | 58 | 4473 |
| 1209639 | N/A | N/A | 6491 | 6506 | CAGCAGTGAATCCCAG | 66 | 4474 |
| 1209652 | N/A | N/A | 6574 | 6589 | TAGTTGGCCTTTGCAG | 33 | 4475 |
| 1209665 | N/A | N/A | 6637 | 6652 | ACCACCCATCCAGAGT | 54 | 4476 |
| 1209678 | N/A | N/A | 6736 | 6751 | GAGGAGGTGCCATTAA | 37 | 4477 |
| 1209691 | N/A | N/A | 6805 | 6820 | TGGACAAAGCTGCTCC | 57 | 4478 |
| 1209704 | N/A | N/A | 6869 | 6884 | CCGCCCTGCGAACAC | 48 | 4479 |
| 1209717 | N/A | N/A | 7069 | 7084 | CCTGAGATTTGTGCCT | 88† | 4480 |

TABLE 70

Reduction of FXII RNA by 3-10-3 cEt gapmers with uniform
PS internucleoside linkages (Huh7, electroporation,
2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128802 | 218 | 233 | 3569 | 3584 | TACATTTGTGGTACAG | 99 | 2426 |
| 1129531 | 2009 | 2024 | 7397 | 7412 | GAGTTCCTGCGCCATC | 11 | 3837 |
| 1129948 | N/A | N/A | 4840 | 4855 | ATCTGCTTTCCGCACT | 43 | 3630 |
| 1194291 | N/A | N/A | 4842 | 4857 | TCATCTGCTTTCCGCA | 55 | 4481 |
| 1208276 | N/A | N/A | 118 | 133 | GACAATCCTGGTTCCC | 81 | 4482 |
| 1208310 | N/A | N/A | 182 | 197 | CCACAGGTCATGAGCA | 44 | 4483 |

TABLE 70-continued

Reduction of FXII RNA by 3-10-3 cEt gapmers with uniform
PS internucleoside linkages (Huh7, electroporation,
2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1208342 | N/A | N/A | 231 | 246 | CTTCCGGGCTGGCCTC | 104 | 4484 |
| 1208376 | N/A | N/A | 309 | 324 | TAAGGCCCATCTCCCC | 117 | 4485 |
| 1208407 | N/A | N/A | 349 | 364 | CCAAGACCCAAACCCT | 60 | 4486 |
| 1208438 | N/A | N/A | 424 | 439 | TAAGTCATAGCCTGCC | 71 | 4487 |
| 1208469 | N/A | N/A | 471 | 486 | CCCAAGGTGGAATCTA | 92 | 4488 |
| 1208500 | N/A | N/A | 570 | 585 | CACCATACACATCCCC | 44 | 4489 |
| 1208525 | N/A | N/A | 620 | 635 | CTAGCACCAGGTAGGC | 52 | 4490 |
| 1208559 | N/A | N/A | 650 | 665 | CGATCACTCTAGTGCC | 69 | 4491 |
| 1208582 | N/A | N/A | 698 | 713 | GGCACTTAGACACAGC | 61 | 4492 |
| 1208595 | N/A | N/A | 835 | 850 | GAATGATGCCCATGAG | 65 | 4493 |
| 1208608 | N/A | N/A | 869 | 884 | TTGCCCATTGAAGGCC | 61 | 4494 |
| 1208621 | N/A | N/A | 907 | 922 | AGGCATTCAGATGCCA | 43 | 4495 |
| 1208634 | N/A | N/A | 951 | 966 | CGCCCAGAGTCACCCA | 58 | 4496 |
| 1208647 | N/A | N/A | 1007 | 1022 | GTTATCAACCTGGTTT | 76 | 4497 |
| 1208660 | N/A | N/A | 1026 | 1041 | CAACCCTAAGAGGTTT | 83 | 4498 |
| 1208673 | N/A | N/A | 1074 | 1089 | ATGCACCAGGTGATGG | 48 | 4499 |
| 1208686 | N/A | N/A | 1140 | 1155 | AATGGCAGGTACCCTT | 64 | 4500 |
| 1208699 | N/A | N/A | 1205 | 1220 | AGGTAATTTAGTGTCT | 96 | 4501 |
| 1208712 | N/A | N/A | 1550 | 1565 | GTCCATCTGGTTCACA | 69 | 4502 |
| 1208725 | N/A | N/A | 1581 | 1596 | AACCCCACCAAGTCAG | 55 | 4503 |
| 1208749 | N/A | N/A | 1629 | 1644 | AGTCCAGGGTTGGAAT | 45 | 4504 |
| 1208777 | N/A | N/A | 1700 | 1715 | GGCACCAAGTTTGGGT | 72 | 4505 |
| 1208803 | N/A | N/A | 1766 | 1781 | AAGATGCAGATGGGAT | 99 | 4506 |
| 1208828 | N/A | N/A | 2083 | 2098 | ATGGACCTTTAAGATG | 58 | 4507 |
| 1208855 | N/A | N/A | 2118 | 2133 | CCAGAACTAGGACAGT | 70 | 4508 |
| 1208882 | N/A | N/A | 2135 | 2150 | ACTTGCCAAGGACCAA | 40 | 4509 |
| 1208906 | N/A | N/A | 2173 | 2188 | AATAAGCTTTTGCCAC | 69 | 4510 |
| 1208932 | N/A | N/A | 2208 | 2223 | AATGCTGAGCAGTGTC | 96 | 4511 |
| 1208959 | N/A | N/A | 2278 | 2293 | GCGAATAATGAGAATT | 50 | 4512 |
| 1208985 | N/A | N/A | 2329 | 2344 | ATACTGTTTGCTAGTT | 81 | 4513 |
| 1209012 | N/A | N/A | 2379 | 2394 | TATGCTGTTGGTTGAT | 54 | 4514 |
| 1209036 | N/A | N/A | 2453 | 2468 | TTAGCATTGATGAATC | 50 | 4515 |
| 1209061 | N/A | N/A | 2482 | 2497 | ATTCAGGTGTGTGCTA | 47 | 4516 |
| 1209088 | N/A | N/A | 2528 | 2543 | AGCACAAGAAGGCTAC | 57 | 4517 |
| 1209112 | N/A | N/A | 2587 | 2602 | GGGATTTGGCTTTTGG | 76 | 4518 |

TABLE 70-continued

Reduction of FXII RNA by 3-10-3 cEt gapmers with uniform
PS internucleoside linkages (Huh7, electroporation,
2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209140 | N/A | N/A | 2699 | 2714 | TTAAGGTTCAACAAGG | 64 | 4519 |
| 1209169 | N/A | N/A | 2723 | 2738 | AGTGAAAAATTTGCAC | 70 | 4520 |
| 1209195 | N/A | N/A | 2779 | 2794 | ACTCCCAAGTCAATAC | 88 | 4521 |
| 1209216 | N/A | N/A | 2811 | 2826 | AGAATGTGCCTACTTG | 37 | 4522 |
| 1209243 | N/A | N/A | 2853 | 2868 | TAATAGTACAGTTGAT | 46 | 4523 |
| 1209266 | N/A | N/A | 2909 | 2924 | CACTGTTAACCACTCT | 84 | 4524 |
| 1209292 | N/A | N/A | 2990 | 3005 | TGGGTAAGTCTTCAGT | 62 | 4525 |
| 1209317 | N/A | N/A | 3044 | 3059 | AGTCAGATAGCTGGAG | 94 | 4526 |
| 1209341 | N/A | N/A | 3416 | 3431 | CAGACCCTCAAAAAGG | 64 | 4527 |
| 1209354 | N/A | N/A | 3467 | 3482 | CTGTACTCAACTGCTC | 47 | 4528 |
| 1209367 | N/A | N/A | 3497 | 3512 | CAGGGACAACACACTC | 61 | 4529 |
| 1209380 | N/A | N/A | 3648 | 3663 | GGTACATGTCTCCCAG | 42 | 4530 |
| 1209393 | N/A | N/A | 3682 | 3697 | CCAAGCAGAGTTCCTT | 74 | 4531 |
| 1209406 | N/A | N/A | 3758 | 3773 | ACCTGTAGAAAGAGAC | 41 | 4532 |
| 1209419 | N/A | N/A | 3893 | 3908 | GATACCAGGAGAGTAA | 70 | 4533 |
| 1209432 | N/A | N/A | 3960 | 3975 | CTTCCAAAGGGTATTG | 79 | 4534 |
| 1209445 | N/A | N/A | 4022 | 4037 | TCCAAGCTTGGTTTAC | 99 | 4535 |
| 1209458 | N/A | N/A | 4055 | 4070 | CCTACTTGCCTTGTGA | 67 | 4536 |
| 1209471 | N/A | N/A | 4130 | 4145 | GTCTGAGAGATGGACA | 54 | 4537 |
| 1209484 | N/A | N/A | 4305 | 4320 | TATTCTGTAGGCCCAG | 38 | 4538 |
| 1209497 | N/A | N/A | 4342 | 4357 | TCTAGGACCATGCCAA | 69 | 4539 |
| 1209510 | N/A | N/A | 4533 | 4548 | GGCCCGTTCCCAACCA | 45 | 4540 |
| 1209523 | N/A | N/A | 4641 | 4656 | GAGGGAACGCAGTGAG | 120 | 4541 |
| 1209536 | N/A | N/A | 4834 | 4849 | TTTCCGCACTCTCCCT | 78 | 4542 |
| 1209549 | N/A | N/A | 5382 | 5397 | CCCCCCACTTCCTAAC | 51 | 4543 |
| 1209562 | N/A | N/A | 5442 | 5457 | AGCCCGCGGCCGGCTG | 82 | 4544 |
| 1209575 | N/A | N/A | 5761 | 5776 | CGCTGGGAGACGGAGG | 31 | 4545 |
| 1209588 | N/A | N/A | 5913 | 5928 | TCAGACCTGGCCACAA | 45 | 4546 |
| 1209601 | N/A | N/A | 6326 | 6341 | CCTAGCAGTTGTGCCT | 70 | 4547 |
| 1209614 | N/A | N/A | 6404 | 6419 | GGCACCCGGAACGATA | 53 | 4548 |
| 1209627 | N/A | N/A | 6461 | 6476 | CCTGGGATTCACCTAC | 51 | 4549 |
| 1209640 | N/A | N/A | 6494 | 6509 | TCCCAGCAGTGAATCC | 49 | 4550 |
| 1209653 | N/A | N/A | 6575 | 6590 | CTAGTTGGCCTTTGCA | 52 | 4551 |
| 1209666 | N/A | N/A | 6638 | 6653 | CACCACCCATCCAGAG | 47 | 4552 |
| 1209679 | N/A | N/A | 6758 | 6773 | CTCTCGCAGCAAGCCC | 52 | 4553 |
| 1209692 | N/A | N/A | 6806 | 6821 | ATGGACAAAGCTGCTC | 29 | 4554 |

TABLE 70-continued

Reduction of FXII RNA by 3-10-3 cEt gapmers with uniform
PS internucleoside linkages (Huh7, electroporation,
2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209705 | N/A | N/A | 6872 | 6887 | CCTCCGCCCCTGCGAA | 60 | 4555 |
| 1209718 | N/A | N/A | 7070 | 7085 | ACCTGAGATTTGTGCC | 65† | 4556 |

TABLE 71

Reduction of FXII RNA by 3-10-3 cEt gapmers with
uniform PS internucleoside linkages (Huh7,
electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128802 | 218 | 233 | 3569 | 3584 | TACATTTGTGGTACAG | 35 | 2426 |
| 1129531 | 2009 | 2024 | 7397 | 7412 | GAGTTCCTGCGCCATC | 14 | 3837 |
| 1129948 | N/A | N/A | 4840 | 4855 | ATCTGCTTTCCGCACT | 31 | 3630 |
| 1194292 | N/A | N/A | 4843 | 4858 | CTCATCTGCTTTCCGC | 65 | 4557 |
| 1208277 | N/A | N/A | 121 | 136 | TGGGACAATCCTGGTT | 92 | 4558 |
| 1208312 | N/A | N/A | 183 | 198 | CCCACAGGTCATGAGC | 63 | 4559 |
| 1208347 | N/A | N/A | 233 | 248 | GCCTTCCGGGCTGGCC | 57 | 4560 |
| 1208378 | N/A | N/A | 310 | 325 | TTAAGGCCCATCTCCC | 111 | 4561 |
| 1208408 | N/A | N/A | 358 | 373 | GATTTCTTCCCAAGAC | 49 | 4562 |
| 1208439 | N/A | N/A | 430 | 445 | TGACTATAAGTCATAG | 43 | 4563 |
| 1208473 | N/A | N/A | 472 | 487 | TCCCAAGGTGGAATCT | 75 | 4564 |
| 1208502 | N/A | N/A | 572 | 587 | TGCACCATACACATCC | 59 | 4565 |
| 1208529 | N/A | N/A | 621 | 636 | CCTAGCACCAGGTAGG | 40 | 4566 |
| 1208562 | N/A | N/A | 651 | 666 | ACGATCACTCTAGTGC | 78 | 4567 |
| 1208583 | N/A | N/A | 717 | 732 | GCTCCGAGCCAGGCTC | 81 | 4568 |
| 1208596 | N/A | N/A | 836 | 851 | TGAATGATGCCCATGA | 41 | 4569 |
| 1208609 | N/A | N/A | 872 | 887 | TCCTTGCCCATTGAAG | 72 | 4570 |
| 1208622 | N/A | N/A | 909 | 924 | AGAGGCATTCAGATGC | 109 | 4571 |
| 1208635 | N/A | N/A | 952 | 967 | TCGCCCAGAGTCACCC | 55 | 4572 |
| 1208648 | N/A | N/A | 1008 | 1023 | TGTTATCAACCTGGTT | 42 | 4573 |
| 1208661 | N/A | N/A | 1036 | 1051 | CCCTTCTCAACAACCC | 76 | 4574 |
| 1208674 | N/A | N/A | 1076 | 1091 | CCATGCACCAGGTGAT | 52 | 4575 |
| 1208687 | N/A | N/A | 1141 | 1156 | AAATGGCAGGTACCCT | 103 | 4576 |
| 1208700 | N/A | N/A | 1209 | 1224 | ATGTAGGTAATTTAGT | 76 | 4577 |
| 1208713 | N/A | N/A | 1552 | 1567 | AGGTCCATCTGGTTCA | 84 | 4578 |
| 1208726 | N/A | N/A | 1582 | 1597 | CAACCCCACCAAGTCA | 45 | 4579 |

TABLE 71-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1208752 | N/A | N/A | 1630 | 1645 | GAGTCCAGGGTTGGAA | 26 | 4580 |
| 1208779 | N/A | N/A | 1703 | 1718 | TAGGGCACCAAGTTTG | 27 | 4581 |
| 1208805 | N/A | N/A | 1913 | 1928 | GAAGTTGTGTGCCTGT | 64 | 4582 |
| 1208829 | N/A | N/A | 2085 | 2100 | AGATGGACCTTTAAGA | 34 | 4583 |
| 1208856 | N/A | N/A | 2119 | 2134 | ACCAGAACTAGGACAG | 57 | 4584 |
| 1208884 | N/A | N/A | 2136 | 2151 | CACTTGCCAAGGACCA | 47 | 4585 |
| 1208909 | N/A | N/A | 2174 | 2189 | CAATAAGCTTTTGCCA | 78 | 4586 |
| 1208933 | N/A | N/A | 2214 | 2229 | CCATGAAATGCTGAGC | 29 | 4587 |
| 1208960 | N/A | N/A | 2286 | 2301 | TAACCATCGCGAATAA | 52 | 4588 |
| 1208988 | N/A | N/A | 2331 | 2346 | TAATACTGTTTGCTAG | 48 | 4589 |
| 1209013 | N/A | N/A | 2384 | 2399 | GATTATATGCTGTTGG | 82 | 4590 |
| 1209039 | N/A | N/A | 2454 | 2469 | CTTAGCATTGATGAAT | 51 | 4591 |
| 1209064 | N/A | N/A | 2484 | 2499 | TGATTCAGGTGTGTGC | 75 | 4592 |
| 1209089 | N/A | N/A | 2537 | 2552 | TAGTTCCTAAGCACAA | 32 | 4593 |
| 1209115 | N/A | N/A | 2614 | 2629 | CGTTTTTCACACTTTG | 40 | 4594 |
| 1209142 | N/A | N/A | 2701 | 2716 | AGTTAAGGTTCAACAA | 55 | 4595 |
| 1209170 | N/A | N/A | 2725 | 2740 | GCAGTGAAAAATTTGC | 62 | 4596 |
| 1209196 | N/A | N/A | 2780 | 2795 | AACTCCCAAGTCAATA | 30 | 4597 |
| 1209219 | N/A | N/A | 2812 | 2827 | GAGAATGTGCCTACTT | 40 | 4598 |
| 1209244 | N/A | N/A | 2864 | 2879 | AACGGCAGTAATAATA | 69 | 4599 |
| 1209269 | N/A | N/A | 2914 | 2929 | GAAGTCACTGTTAACC | 65 | 4600 |
| 1209293 | N/A | N/A | 2993 | 3008 | CCTTGGGTAAGTCTTC | 86 | 4601 |
| 1209320 | N/A | N/A | 3050 | 3065 | TTCAGGAGTCAGATAG | 87 | 4602 |
| 1209342 | N/A | N/A | 3419 | 3434 | GGACAGACCCTCAAAA | 54 | 4603 |
| 1209355 | N/A | N/A | 3468 | 3483 | CCTGTACTCAACTGCT | 36 | 4604 |
| 1209368 | N/A | N/A | 3498 | 3513 | GCAGGGACAACACACT | 53 | 4605 |
| 1209381 | N/A | N/A | 3650 | 3665 | AGGGTACATGTCTCCC | 93 | 4606 |
| 1209394 | N/A | N/A | 3684 | 3699 | CTCCAAGCAGAGTTCC | 56 | 4607 |
| 1209407 | N/A | N/A | 3760 | 3775 | ACACCTGTAGAAAGAG | 58 | 4608 |
| 1209420 | N/A | N/A | 3894 | 3909 | TGATACCAGGAGAGTA | 61 | 4609 |
| 1209433 | N/A | N/A | 3961 | 3976 | ACTTCCAAAGGGTATT | 26 | 4610 |
| 1209446 | N/A | N/A | 4023 | 4038 | TTCCAAGCTTGGTTTA | 48 | 4611 |
| 1209459 | N/A | N/A | 4056 | 4071 | ACCTACTTGCCTTGTG | 31 | 4612 |
| 1209472 | N/A | N/A | 4131 | 4146 | GGTCTGAGAGATGGAC | 41 | 4613 |
| 1209485 | N/A | N/A | 4307 | 4322 | CCTATTCTGTAGGCCC | 71 | 4614 |
| 1209498 | N/A | N/A | 4346 | 4361 | AGAGTCTAGGACCATG | 50 | 4615 |

TABLE 71-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209511 | N/A | N/A | 4577 | 4592 | ACCACCCGGCCTCCTG | 71 | 4616 |
| 1209524 | N/A | N/A | 4642 | 4657 | GGAGGGAACGCAGTGA | 113 | 4617 |
| 1209537 | N/A | N/A | 4909 | 4924 | TTGCCTTGGTGTCTGA | 40 | 4618 |
| 1209550 | N/A | N/A | 5383 | 5398 | CCCCCCCACTTCCTAA | 68 | 4619 |
| 1209563 | N/A | N/A | 5444 | 5459 | AGAGCCCGCGGCCGGC | 79 | 4620 |
| 1209576 | N/A | N/A | 5767 | 5782 | AAGCTGCGCTGGGAGA | 43 | 4621 |
| 1209589 | N/A | N/A | 5918 | 5933 | CGCTCTCAGACCTGGC | 79 | 4622 |
| 1209602 | N/A | N/A | 6336 | 6351 | TACCCCTGCCCCTAGC | 51 | 4623 |
| 1209615 | N/A | N/A | 6411 | 6426 | TTCTGTAGGCACCCGG | 49 | 4624 |
| 1209628 | N/A | N/A | 6465 | 6480 | TCTACCTGGGATTCAC | 84 | 4625 |
| 1209641 | N/A | N/A | 6495 | 6510 | ATCCCAGCAGTGAATC | 111 | 4626 |
| 1209654 | N/A | N/A | 6601 | 6616 | CTAGCCCGGAGCGCGG | 66 | 4627 |
| 1209667 | N/A | N/A | 6660 | 6675 | GCGGAAACAGAAACCC | 49 | 4628 |
| 1209680 | N/A | N/A | 6764 | 6779 | CTTCCTCTCTCGCAGC | 60 | 4629 |
| 1209693 | N/A | N/A | 6807 | 6822 | GATGGACAAAGCTGCT | 87 | 4630 |
| 1209706 | N/A | N/A | 6875 | 6890 | ATTCCTCCGCCCCTGC | 76 | 4631 |
| 1209719 | N/A | N/A | 7071 | 7086 | GACCTGAGATTTGTGC | 98† | 4632 |

TABLE 72

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128802 | 218 | 233 | 3569 | 3584 | TACATTTGTGGTACAG | 20 | 2426 |
| 1129531 | 2009 | 2024 | 7397 | 7412 | GAGTTCCTGCGCCATC | 8 | 3837 |
| 1129948 | N/A | N/A | 4840 | 4855 | ATCTGCTTTCCGCACT | 21 | 3630 |
| 1129949 | N/A | N/A | 4844 | 4859 | TCTCATCTGCTTTCCG | 27 | 3706 |
| 1208281 | N/A | N/A | 122 | 137 | CTGGGACAATCCTGGT | 104 | 4633 |
| 1208314 | N/A | N/A | 184 | 199 | ACCCACAGGTCATGAG | 28 | 4634 |
| 1208349 | N/A | N/A | 234 | 249 | GGCCTTCCGGGCTGGC | 59 | 4635 |
| 1208379 | N/A | N/A | 311 | 326 | CTTAAGGCCCATCTCC | 37 | 4636 |
| 1208412 | N/A | N/A | 398 | 413 | TGCTAGTCTGCAGCTT | 35 | 4637 |
| 1208443 | N/A | N/A | 431 | 446 | CTGACTATAAGTCATA | 47 | 4638 |
| 1208476 | N/A | N/A | 517 | 532 | CCGACTGTGTGCTCTT | 13 | 4639 |

TABLE 72-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1208504 | N/A | N/A | 573 | 588 | CTGCACCATACACATC | 27 | 4640 |
| 1208530 | N/A | N/A | 622 | 637 | ACCTAGCACCAGGTAG | 85 | 4641 |
| 1208564 | N/A | N/A | 656 | 671 | AGCTCACGATCACTCT | 86 | 4642 |
| 1208584 | N/A | N/A | 718 | 733 | TGCTCCGAGCCAGGCT | 45 | 4643 |
| 1208597 | N/A | N/A | 837 | 852 | ATGAATGATGCCCATG | 35 | 4644 |
| 1208610 | N/A | N/A | 878 | 893 | GATCCTTCCTTGCCCA | 27 | 4645 |
| 1208623 | N/A | N/A | 913 | 928 | CTTCAGAGGCATTCAG | 65 | 4646 |
| 1208636 | N/A | N/A | 954 | 969 | CCTCGCCCAGAGTCAC | 109 | 4647 |
| 1208649 | N/A | N/A | 1011 | 1026 | TACTGTTATCAACCTG | 40 | 4648 |
| 1208662 | N/A | N/A | 1046 | 1061 | ACATGGGTTTCCCTTC | 52 | 4649 |
| 1208675 | N/A | N/A | 1078 | 1093 | TTCCATGCACCAGGTG | 34 | 4650 |
| 1208688 | N/A | N/A | 1142 | 1157 | GAAATGGCAGGTACCC | 47 | 4651 |
| 1208701 | N/A | N/A | 1210 | 1225 | CATGTAGGTAATTTAG | 21 | 4652 |
| 1208714 | N/A | N/A | 1554 | 1569 | TAAGGTCCATCTGGTT | 92 | 4653 |
| 1208729 | N/A | N/A | 1584 | 1599 | CTCAACCCCACCAAGT | 79 | 4654 |
| 1208753 | N/A | N/A | 1667 | 1682 | AAACTTTTGGGTGTGG | 35 | 4655 |
| 1208782 | N/A | N/A | 1705 | 1720 | GATAGGGCACCAAGTT | 85 | 4656 |
| 1208806 | N/A | N/A | 1915 | 1930 | ATGAAGTTGTGTGCCT | 48 | 4657 |
| 1208832 | N/A | N/A | 2086 | 2101 | GAGATGGACCTTTAAG | 38 | 4658 |
| 1208859 | N/A | N/A | 2122 | 2137 | CAAACCAGAACTAGGA | 58 | 4659 |
| 1208887 | N/A | N/A | 2142 | 2157 | AAAGTGCACTTGCCAA | 29 | 4660 |
| 1208910 | N/A | N/A | 2175 | 2190 | TCAATAAGCTTTTGCC | 31 | 4661 |
| 1208936 | N/A | N/A | 2215 | 2230 | GCCATGAAATGCTGAG | 24 | 4662 |
| 1208963 | N/A | N/A | 2294 | 2309 | ATAGAACATAACCATC | 35 | 4663 |
| 1208989 | N/A | N/A | 2333 | 2348 | CCTAATACTGTTTGCT | 21 | 4664 |
| 1209016 | N/A | N/A | 2385 | 2400 | AGATTATATGCTGTTG | 23 | 4665 |
| 1209040 | N/A | N/A | 2455 | 2470 | GCTTAGCATTGATGAA | 51 | 4666 |
| 1209065 | N/A | N/A | 2486 | 2501 | CTTGATTCAGGTGTGT | 31 | 4667 |
| 1209092 | N/A | N/A | 2538 | 2553 | GTAGTTCCTAAGCACA | 48 | 4668 |
| 1209118 | N/A | N/A | 2630 | 2645 | AGTCTACTTAGTGCAA | 39 | 4669 |
| 1209144 | N/A | N/A | 2702 | 2717 | CAGTTAAGGTTCAACA | 26 | 4670 |
| 1209173 | N/A | N/A | 2744 | 2759 | ATTTGTGGGCATGCAC | 57 | 4671 |
| 1209199 | N/A | N/A | 2781 | 2796 | TAACTCCCAAGTCAAT | 49 | 4672 |
| 1209220 | N/A | N/A | 2813 | 2828 | TGAGAATGTGCCTACT | 24 | 4673 |
| 1209246 | N/A | N/A | 2865 | 2880 | AAACGGCAGTAATAAT | 59 | 4674 |
| 1209270 | N/A | N/A | 2917 | 2932 | GTTGAAGTCACTGTTA | 23 | 4675 |

TABLE 72-continued

Reduction of FXII RNA by 3-10-3 cEt gapmers with
uniform PS internucleoside linkages (Huh7,
electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209296 | N/A | N/A | 3013 | 3028 | ACAACCTGCTAGCTGT | 73 | 4676 |
| 1209321 | N/A | N/A | 3051 | 3066 | GTTCAGGAGTCAGATA | 57 | 4677 |
| 1209343 | N/A | N/A | 3421 | 3436 | AAGGACAGACCCTCAA | 60 | 4678 |
| 1209356 | N/A | N/A | 3470 | 3485 | CCCCTGTACTCAACTG | 64 | 4679 |
| 1209369 | N/A | N/A | 3499 | 3514 | TGCAGGGACAACACAC | 82 | 4680 |
| 1209382 | N/A | N/A | 3651 | 3666 | CAGGGTACATGTCTCC | 39 | 4681 |
| 1209395 | N/A | N/A | 3686 | 3701 | CTCTCCAAGCAGAGTT | 74 | 4682 |
| 1209408 | N/A | N/A | 3762 | 3777 | GCACACCTGTAGAAAG | 54 | 4683 |
| 1209421 | N/A | N/A | 3896 | 3911 | GGTGATACCAGGAGAG | 56 | 4684 |
| 1209434 | N/A | N/A | 3962 | 3977 | GACTTCCAAAGGGTAT | 57 | 4685 |
| 1209447 | N/A | N/A | 4025 | 4040 | GTTTCCAAGCTTGGTT | 55 | 4686 |
| 1209460 | N/A | N/A | 4057 | 4072 | AACCTACTTGCCTTGT | 28 | 4687 |
| 1209473 | N/A | N/A | 4242 | 4257 | CACCTTTCTGGCAGTG | 56 | 4688 |
| 1209486 | N/A | N/A | 4317 | 4332 | TATCCAGCAACCTATT | 45 | 4689 |
| 1209499 | N/A | N/A | 4351 | 4366 | TCAGGAGAGTCTAGGA | 42 | 4690 |
| 1209512 | N/A | N/A | 4579 | 4594 | ACACCACCCGGCCTCC | 30 | 4691 |
| 1209525 | N/A | N/A | 4657 | 4672 | GTGCGGCAGGCTTGGG | 27 | 4692 |
| 1209538 | N/A | N/A | 5077 | 5092 | CCCACGCGGCGCACCG | 57 | 4693 |
| 1209551 | N/A | N/A | 5404 | 5419 | GCCCTCTCGGCTCCTC | 33 | 4694 |
| 1209564 | N/A | N/A | 5445 | 5460 | GAGAGCCCGCGGCCGG | 60 | 4695 |
| 1209577 | N/A | N/A | 5771 | 5786 | GTGGAAGCTGCGCTGG | 30 | 4696 |
| 1209590 | N/A | N/A | 5919 | 5934 | GCGCTCTCAGACCTGG | 111 | 4697 |
| 1209603 | N/A | N/A | 6352 | 6367 | CAAAGGTCTCCTCCCC | 54 | 4698 |
| 1209616 | N/A | N/A | 6414 | 6429 | CCATTCTGTAGGCACC | 25 | 4699 |
| 1209629 | N/A | N/A | 6468 | 6483 | GATTCTACCTGGGATT | 70 | 4700 |
| 1209642 | N/A | N/A | 6496 | 6511 | GATCCCAGCAGTGAAT | 74 | 4701 |
| 1209655 | N/A | N/A | 6607 | 6622 | CCCACACTAGCCCGGA | 80 | 4702 |
| 1209668 | N/A | N/A | 6661 | 6676 | AGCGGAAACAGAAACC | 83 | 4703 |
| 1209681 | N/A | N/A | 6766 | 6781 | CCCTTCCTCTCTCGCA | 67 | 4704 |
| 1209694 | N/A | N/A | 6808 | 6823 | CGATGGACAAAGCTGC | 40 | 4705 |
| 1209707 | N/A | N/A | 7014 | 7029 | ACCTGGCACGCATCGG | 10† | 4706 |
| 1209720 | N/A | N/A | 7073 | 7088 | TGGACCTGAGATTTGT | 44† | 4707 |

TABLE 73

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128802 | 218 | 233 | 3569 | 3584 | TACATTTGTGGTACAG | 42 | 2426 |
| 1129531 | 2009 | 2024 | 7397 | 7412 | GAGTTCCTGCGCCATC | 12 | 3837 |
| 1129948 | N/A | N/A | 4840 | 4855 | ATCTGCTTTCCGCACT | 25 | 3630 |
| 1194293 | N/A | N/A | 4845 | 4860 | CTCTCATCTGCTTTCC | 46 | 4708 |
| 1208282 | N/A | N/A | 124 | 139 | TCCTGGGACAATCCTG | 94 | 4709 |
| 1208317 | N/A | N/A | 185 | 200 | GACCCACAGGTCATGA | 41 | 4710 |
| 1208351 | N/A | N/A | 265 | 280 | ACCCAGTCTGGTTGTC | 54 | 4711 |
| 1208382 | N/A | N/A | 312 | 327 | TCTTAAGGCCCATCTC | 78 | 4712 |
| 1208413 | N/A | N/A | 399 | 414 | TTGCTAGTCTGCAGCT | 22 | 4713 |
| 1208444 | N/A | N/A | 432 | 447 | ACTGACTATAAGTCAT | 79 | 4714 |
| 1208478 | N/A | N/A | 518 | 533 | ACCGACTGTGTGCTCT | 26 | 4715 |
| 1208506 | N/A | N/A | 576 | 591 | ACACTGCACCATACAC | 18 | 4716 |
| 1208534 | N/A | N/A | 625 | 640 | AAGACCTAGCACCAGG | 25 | 4717 |
| 1208566 | N/A | N/A | 657 | 672 | CAGCTCACGATCACTC | 40 | 4718 |
| 1208585 | N/A | N/A | 721 | 736 | ACCTGCTCCGAGCCAG | 79 | 4719 |
| 1208598 | N/A | N/A | 838 | 853 | CATGAATGATGCCCAT | 36 | 4720 |
| 1208611 | N/A | N/A | 881 | 896 | CTTGATCCTTCCTTGC | 39 | 4721 |
| 1208624 | N/A | N/A | 914 | 929 | GCTTCAGAGGCATTCA | 45 | 4722 |
| 1208637 | N/A | N/A | 961 | 976 | TCAAATCCCTCGCCCA | 63 | 4723 |
| 1208650 | N/A | N/A | 1012 | 1027 | TTACTGTTATCAACCT | 34 | 4724 |
| 1208663 | N/A | N/A | 1048 | 1063 | TCACATGGGTTTCCCT | 30 | 4725 |
| 1208676 | N/A | N/A | 1080 | 1095 | ATTTCCATGCACCAGG | 105 | 4726 |
| 1208689 | N/A | N/A | 1143 | 1158 | GGAAATGGCAGGTACC | 26 | 4727 |
| 1208702 | N/A | N/A | 1211 | 1226 | GCATGTAGGTAATTTA | 44 | 4728 |
| 1208715 | N/A | N/A | 1563 | 1578 | CCACCAGGGTAAGGTC | 30 | 4729 |
| 1208730 | N/A | N/A | 1585 | 1600 | ACTCAACCCCACCAAG | 143 | 4730 |
| 1208756 | N/A | N/A | 1669 | 1684 | AGAAACTTTTGGGTGT | 55 | 4731 |
| 1208784 | N/A | N/A | 1706 | 1721 | GGATAGGGCACCAAGT | 110 | 4732 |
| 1208808 | N/A | N/A | 1918 | 1933 | AGCATGAAGTTGTGTG | 68 | 4733 |
| 1208833 | N/A | N/A | 2087 | 2102 | TGAGATGGACCTTTAA | 63 | 4734 |
| 1208860 | N/A | N/A | 2123 | 2138 | CCAAACCAGAACTAGG | 26 | 4735 |
| 1208888 | N/A | N/A | 2144 | 2159 | GCAAAGTGCACTTGCC | 79 | 4736 |
| 1208913 | N/A | N/A | 2177 | 2192 | GCTCAATAAGCTTTTG | 29 | 4737 |
| 1208937 | N/A | N/A | 2216 | 2231 | TGCCATGAAATGCTGA | 32 | 4738 |
| 1208964 | N/A | N/A | 2316 | 2331 | GTTCAATGTTCACTGT | 31 | 4739 |
| 1208992 | N/A | N/A | 2334 | 2349 | ACCTAATACTGTTTGC | 59 | 4740 |

TABLE 73-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209017 | N/A | N/A | 2386 | 2401 | CAGATTATATGCTGTT | 18 | 4741 |
| 1209043 | N/A | N/A | 2456 | 2471 | AGCTTAGCATTGATGA | 38 | 4742 |
| 1209068 | N/A | N/A | 2488 | 2503 | CACTTGATTCAGGTGT | 66 | 4743 |
| 1209093 | N/A | N/A | 2539 | 2554 | TGTAGTTCCTAAGCAC | 35 | 4744 |
| 1209119 | N/A | N/A | 2633 | 2648 | CTCAGTCTACTTAGTG | 16 | 4745 |
| 1209147 | N/A | N/A | 2704 | 2719 | CCCAGTTAAGGTTCAA | 40 | 4746 |
| 1209174 | N/A | N/A | 2745 | 2760 | CATTTGTGGGCATGCA | 41 | 4747 |
| 1209200 | N/A | N/A | 2782 | 2797 | GTAACTCCCAAGTCAA | 64 | 4748 |
| 1209247 | N/A | N/A | 2868 | 2883 | GTAAAACGGCAGTAAT | 56 | 4749 |
| 1209273 | N/A | N/A | 2924 | 2939 | GTTGAATGTTGAAGTC | 53 | 4750 |
| 1209297 | N/A | N/A | 3014 | 3029 | CACAACCTGCTAGCTG | 36 | 4751 |
| 1209324 | N/A | N/A | 3059 | 3074 | AAACTTGGGTTCAGGA | 43 | 4752 |
| 1209344 | N/A | N/A | 3422 | 3437 | AAAGGACAGACCCTCA | 55 | 4753 |
| 1209357 | N/A | N/A | 3471 | 3486 | TCCCCTGTACTCAACT | 123 | 4754 |
| 1209370 | N/A | N/A | 3501 | 3516 | ACTGCAGGGACAACAC | 26 | 4755 |
| 1209383 | N/A | N/A | 3654 | 3669 | AGGCAGGGTACATGTC | 55 | 4756 |
| 1209396 | N/A | N/A | 3700 | 3715 | TATCACAGTCCCCTCT | 45 | 4757 |
| 1209409 | N/A | N/A | 3836 | 3851 | GTGTAGCACCTTTCAC | 58 | 4758 |
| 1209422 | N/A | N/A | 3898 | 3913 | CTGGTGATACCAGGAG | 17 | 4759 |
| 1209435 | N/A | N/A | 3975 | 3990 | AACTCTCCCTCTGGAC | 41 | 4760 |
| 1209448 | N/A | N/A | 4026 | 4041 | AGTTTCCAAGCTTGGT | 26 | 4761 |
| 1209461 | N/A | N/A | 4063 | 4078 | TTCTTGAACCTACTTG | 96 | 4762 |
| 1209474 | N/A | N/A | 4243 | 4258 | TCACCTTTCTGGCAGT | 33 | 4763 |
| 1209487 | N/A | N/A | 4319 | 4334 | AGTATCCAGCAACCTA | 42 | 4764 |
| 1209500 | N/A | N/A | 4352 | 4367 | CTCAGGAGAGTCTAGG | 79 | 4765 |
| 1209513 | N/A | N/A | 4605 | 4620 | CCCCCCAGAGAGCTCT | 40 | 4766 |
| 1209526 | N/A | N/A | 4660 | 4675 | TTGGTGCGGCAGGCTT | 26 | 4767 |
| 1209539 | N/A | N/A | 5079 | 5094 | GCCCCACGCGGCGCAC | 46 | 4768 |
| 1209552 | N/A | N/A | 5405 | 5420 | CGCCCTCTCGGCTCCT | 52 | 4769 |
| 1209565 | N/A | N/A | 5454 | 5469 | CTGAGGACGGAGAGCC | 19 | 4770 |
| 1209578 | N/A | N/A | 5802 | 5817 | GGAGAAGGTAGGGCAC | 101 | 4771 |
| 1209591 | N/A | N/A | 6090 | 6105 | CCCACGCACCCAGGTC | 57 | 4772 |
| 1209604 | N/A | N/A | 6353 | 6368 | TCAAAGGTCTCCTCCC | 100 | 4773 |
| 1209617 | N/A | N/A | 6416 | 6431 | ACCCATTCTGTAGGCA | 73 | 4774 |
| 1209630 | N/A | N/A | 6469 | 6484 | GGATTCTACCTGGGAT | 33 | 4775 |

TABLE 73-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209643 | N/A | N/A | 6516 | 6531 | GTATCCCCAGGAGATT | 59 | 4776 |
| 1209656 | N/A | N/A | 6609 | 6624 | CTCCCACACTAGCCCG | 91 | 4777 |
| 1209669 | N/A | N/A | 6662 | 6677 | GAGCGGAAACAGAAAC | 75 | 4778 |
| 1209682 | N/A | N/A | 6777 | 6792 | ACCCACTCATGCCCTT | 76 | 4779 |
| 1209695 | N/A | N/A | 6820 | 6835 | TTGCCGCCCGGACGAT | 31 | 4780 |
| 1209708 | N/A | N/A | 7023 | 7038 | TAAGAGCTCACCTGGC | 57[†] | 4781 |
| 1209721 | N/A | N/A | 7079 | 7094 | GCGCTGTGGACCTGAG | 37[†] | 4782 |

TABLE 74

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128802 | 218 | 233 | 3569 | 3584 | TACATTTGTGGTACAG | 29 | 2426 |
| 1129531 | 2009 | 2024 | 7397 | 7412 | GAGTTCCTGCGCCATC | 18 | 3837 |
| 1129948 | N/A | N/A | 4840 | 4855 | ATCTGCTTTCCGCACT | 54 | 3630 |
| 1194294 | N/A | N/A | 4846 | 4861 | CCTCTCATCTGCTTTC | 27 | 4783 |
| 1208286 | N/A | N/A | 125 | 140 | ATCCTGGGACAATCCT | 50 | 4784 |
| 1208319 | N/A | N/A | 188 | 203 | CTGGACCCACAGGTCA | 42 | 4785 |
| 1208354 | N/A | N/A | 266 | 281 | CACCCAGTCTGGTTGT | 49 | 4786 |
| 1208383 | N/A | N/A | 313 | 328 | TTCTTAAGGCCCATCT | 79 | 4787 |
| 1208417 | N/A | N/A | 400 | 415 | GTTGCTAGTCTGCAGC | 58 | 4788 |
| 1208448 | N/A | N/A | 433 | 448 | AACTGACTATAAGTCA | 25 | 4789 |
| 1208480 | N/A | N/A | 519 | 534 | TACCGACTGTGTGCTC | 49 | 4790 |
| 1208508 | N/A | N/A | 578 | 593 | ACACACTGCACCATAC | 22 | 4791 |
| 1208535 | N/A | N/A | 627 | 642 | ATAAGACCTAGCACCA | 40 | 4792 |
| 1208568 | N/A | N/A | 658 | 673 | ACAGCTCACGATCACT | 30 | 4793 |
| 1208586 | N/A | N/A | 724 | 739 | AGCACCTGCTCCGAGC | 81 | 4794 |
| 1208599 | N/A | N/A | 839 | 854 | GCATGAATGATGCCCA | 55 | 4795 |
| 1208612 | N/A | N/A | 885 | 900 | AGCTCTTGATCCTTCC | 18 | 4796 |
| 1208625 | N/A | N/A | 915 | 930 | GGCTTCAGAGGCATTC | 57 | 4797 |
| 1208638 | N/A | N/A | 962 | 977 | CTCAAATCCCTCGCCC | 27 | 4798 |
| 1208651 | N/A | N/A | 1013 | 1028 | TTTACTGTTATCAACC | 22 | 4799 |
| 1208664 | N/A | N/A | 1049 | 1064 | CTCACATGGGTTTCCC | 52 | 4800 |
| 1208677 | N/A | N/A | 1122 | 1137 | TCTAAAAGGTAGTTTC | 27 | 4801 |

TABLE 74-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1208690 | N/A | N/A | 1144 | 1159 | GGGAAATGGCAGGTAC | 30 | 4802 |
| 1208703 | N/A | N/A | 1212 | 1227 | GGCATGTAGGTAATTT | 44 | 4803 |
| 1208716 | N/A | N/A | 1564 | 1579 | CCCACCAGGGTAAGGT | 147 | 4804 |
| 1208731 | N/A | N/A | 1589 | 1604 | AGAGACTCAACCCCAC | 50 | 4805 |
| 1208757 | N/A | N/A | 1670 | 1685 | GAGAAACTTTTGGGTG | 19 | 4806 |
| 1208786 | N/A | N/A | 1714 | 1729 | TTAGGCAAGGATAGGG | 79 | 4807 |
| 1208809 | N/A | N/A | 1919 | 1934 | GAGCATGAAGTTGTGT | 73 | 4808 |
| 1208836 | N/A | N/A | 2088 | 2103 | CTGAGATGGACCTTTA | 26 | 4809 |
| 1208863 | N/A | N/A | 2124 | 2139 | ACCAAACCAGAACTAG | 24 | 4810 |
| 1208891 | N/A | N/A | 2147 | 2162 | AAGGCAAAGTGCACTT | 42 | 4811 |
| 1208914 | N/A | N/A | 2179 | 2194 | CTGCTCAATAAGCTTT | 96 | 4812 |
| 1208940 | N/A | N/A | 2219 | 2234 | TAATGCCATGAAATGC | 58 | 4813 |
| 1208967 | N/A | N/A | 2318 | 2333 | TAGTTCAATGTTCACT | 27 | 4814 |
| 1208993 | N/A | N/A | 2335 | 2350 | AACCTAATACTGTTTG | 30 | 4815 |
| 1209020 | N/A | N/A | 2387 | 2402 | CCAGATTATATGCTGT | 40 | 4816 |
| 1209044 | N/A | N/A | 2458 | 2473 | TCAGCTTAGCATTGAT | 52 | 4817 |
| 1209069 | N/A | N/A | 2491 | 2506 | AGACACTTGATTCAGG | 21 | 4818 |
| 1209096 | N/A | N/A | 2542 | 2557 | CTGTGTAGTTCCTAAG | 28 | 4819 |
| 1209122 | N/A | N/A | 2639 | 2654 | GTCCTTCTCAGTCTAC | 32 | 4820 |
| 1209148 | N/A | N/A | 2705 | 2720 | TCCCAGTTAAGGTTCA | 22 | 4821 |
| 1209176 | N/A | N/A | 2747 | 2762 | GCCATTTGTGGGCATG | 24 | 4822 |
| 1209203 | N/A | N/A | 2783 | 2798 | TGTAACTCCCAAGTCA | 80 | 4823 |
| 1209224 | N/A | N/A | 2815 | 2830 | ATTGAGAATGTGCCTA | 39 | 4824 |
| 1209249 | N/A | N/A | 2869 | 2884 | TGTAAAACGGCAGTAA | 27 | 4825 |
| 1209274 | N/A | N/A | 2954 | 2969 | TTGCCACAAAGTAGGC | 45 | 4826 |
| 1209299 | N/A | N/A | 3015 | 3030 | CCACAACCTGCTAGCT | 57 | 4827 |
| 1209325 | N/A | N/A | 3060 | 3075 | AAAACTTGGGTTCAGG | 60 | 4828 |
| 1209345 | N/A | N/A | 3423 | 3438 | AAAAGGACAGACCCTC | 72 | 4829 |
| 1209358 | N/A | N/A | 3472 | 3487 | TTCCCCTGTACTCAAC | 53 | 4830 |
| 1209371 | N/A | N/A | 3502 | 3517 | AACTGCAGGGACAACA | 140 | 4831 |
| 1209384 | N/A | N/A | 3655 | 3670 | CAGGCAGGGTACATGT | 27 | 4832 |
| 1209397 | N/A | N/A | 3701 | 3716 | CTATCACAGTCCCCTC | 39 | 4833 |
| 1209410 | N/A | N/A | 3872 | 3887 | CGGGAGGAGAGAGCCC | 37 | 4834 |
| 1209423 | N/A | N/A | 3918 | 3933 | GAATCCCAGGTGTGTG | 74 | 4835 |
| 1209436 | N/A | N/A | 3994 | 4009 | TGGGACCACTCCTTCC | 48 | 4836 |

TABLE 74-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209449 | N/A | N/A | 4027 | 4042 | AAGTTTCCAAGCTTGG | 24 | 4837 |
| 1209462 | N/A | N/A | 4064 | 4079 | CTTCTTGAACCTACTT | 38 | 4838 |
| 1209475 | N/A | N/A | 4265 | 4280 | CGCCCAGGTCCTCCAC | 59 | 4839 |
| 1209488 | N/A | N/A | 4327 | 4342 | AGTCTCCGAGTATCCA | 112 | 4840 |
| 1209501 | N/A | N/A | 4353 | 4368 | TCTCAGGAGAGTCTAG | 56 | 4841 |
| 1209514 | N/A | N/A | 4606 | 4621 | CCCCCCCAGAGAGCTC | 20 | 4842 |
| 1209527 | N/A | N/A | 4765 | 4780 | GACCCTCACTCACCCA | 72 | 4843 |
| 1209540 | N/A | N/A | 5081 | 5096 | CAGCCCCACGCGGCGC | 76 | 4844 |
| 1209553 | N/A | N/A | 5406 | 5421 | GCGCCCTCTCGGCTCC | 107 | 4845 |
| 1209566 | N/A | N/A | 5455 | 5470 | GCTGAGGACGGAGAGC | 41 | 4846 |
| 1209579 | N/A | N/A | 5845 | 5860 | CTCCCCGGGAGCTCCG | 68 | 4847 |
| 1209592 | N/A | N/A | 6091 | 6106 | CCCCACGCACCCAGGT | 47 | 4848 |
| 1209605 | N/A | N/A | 6354 | 6369 | ATCAAAGGTCTCCTCC | 30 | 4849 |
| 1209618 | N/A | N/A | 6421 | 6436 | GCGCCACCCATTCTGT | 35 | 4850 |
| 1209631 | N/A | N/A | 6472 | 6487 | CTGGGATTCTACCTGG | 30 | 4851 |
| 1209644 | N/A | N/A | 6526 | 6541 | GATTCTCCCTGTATCC | 69 | 4852 |
| 1209657 | N/A | N/A | 6616 | 6631 | AACCTGGCTCCCACAC | 40 | 4853 |
| 1209670 | N/A | N/A | 6663 | 6678 | GGAGCGGAAACAGAAA | 105 | 4854 |
| 1209683 | N/A | N/A | 6778 | 6793 | AACCCACTCATGCCCT | 108 | 4855 |
| 1209696 | N/A | N/A | 6824 | 6839 | ACGCTTGCCGCCCGGA | 32 | 4856 |
| 1209709 | N/A | N/A | 7024 | 7039 | CTAAGAGCTCACCTGG | 82† | 4857 |
| 1209722 | N/A | N/A | 7092 | 7107 | AACACGCAGCTCAGCG | 63† | 4858 |

TABLE 75

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1128802 | 218 | 233 | 3569 | 3584 | TACATTTGTGGTACAG | 94 | 2426 |
| 1129531 | 2009 | 2024 | 7397 | 7412 | GAGTTCCTGCGCCATC | 12 | 3837 |
| 1129948 | N/A | N/A | 4840 | 4855 | ATCTGCTTTCCGCACT | 45 | 3630 |
| 1194295 | N/A | N/A | 4847 | 4862 | CCCTCTCATCTGCTTT | 46 | 4859 |
| 1208287 | N/A | N/A | 129 | 144 | AACAATCCTGGGACAA | 49 | 4860 |
| 1208322 | N/A | N/A | 194 | 209 | AGTCACCTGGACCCAC | 33 | 4861 |
| 1208356 | N/A | N/A | 267 | 282 | CCACCCAGTCTGGTTG | 76 | 4862 |

TABLE 75-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1208387 | N/A | N/A | 314 | 329 | CTTCTTAAGGCCCATC | 52 | 4863 |
| 1208418 | N/A | N/A | 402 | 417 | CTGTTGCTAGTCTGCA | 72 | 4864 |
| 1208449 | N/A | N/A | 438 | 453 | CAGGGAACTGACTATA | 42 | 4865 |
| 1208483 | N/A | N/A | 525 | 540 | GCCACTTACCGACTGT | 50 | 4866 |
| 1208509 | N/A | N/A | 585 | 600 | AGACTGCACACACTGC | 80 | 4867 |
| 1208539 | N/A | N/A | 628 | 643 | CATAAGACCTAGCACC | 54 | 4868 |
| 1208570 | N/A | N/A | 661 | 676 | CACACAGCTCACGATC | 61 | 4869 |
| 1208587 | N/A | N/A | 733 | 748 | CATATCTCAAGCACCT | 40 | 4870 |
| 1208600 | N/A | N/A | 840 | 855 | GGCATGAATGATGCCC | 56 | 4871 |
| 1208613 | N/A | N/A | 886 | 901 | AAGCTCTTGATCCTTC | 102 | 4872 |
| 1208626 | N/A | N/A | 925 | 940 | GATAAAGCTGGGCTTC | 71 | 4873 |
| 1208639 | N/A | N/A | 968 | 983 | GGAGAACTCAAATCCC | 65 | 4874 |
| 1208652 | N/A | N/A | 1014 | 1029 | GTTTACTGTTATCAAC | 79 | 4875 |
| 1208665 | N/A | N/A | 1052 | 1067 | TACCTCACATGGGTTT | 43 | 4876 |
| 1208678 | N/A | N/A | 1124 | 1139 | CATCTAAAAGGTAGTT | 64 | 4877 |
| 1208691 | N/A | N/A | 1164 | 1179 | ATGGCAGAGCTTGAGG | 50 | 4878 |
| 1208704 | N/A | N/A | 1213 | 1228 | TGGCATGTAGGTAATT | 54 | 4879 |
| 1208717 | N/A | N/A | 1565 | 1580 | GCCCACCAGGGTAAGG | 46 | 4880 |
| 1208734 | N/A | N/A | 1595 | 1610 | ATGCTTAGAGACTCAA | 61 | 4881 |
| 1208760 | N/A | N/A | 1671 | 1686 | GGAGAAACTTTTGGGT | 42 | 4882 |
| 1208788 | N/A | N/A | 1715 | 1730 | ATTAGGCAAGGATAGG | 41 | 4883 |
| 1208812 | N/A | N/A | 1920 | 1935 | TGAGCATGAAGTTGTG | 108 | 4884 |
| 1208839 | N/A | N/A | 2091 | 2106 | GATCTGAGATGGACCT | 63 | 4885 |
| 1208865 | N/A | N/A | 2125 | 2140 | GACCAAACCAGAACTA | 69 | 4886 |
| 1208892 | N/A | N/A | 2148 | 2163 | CAAGGCAAAGTGCACT | 65 | 4887 |
| 1208917 | N/A | N/A | 2181 | 2196 | ACCTGCTCAATAAGCT | 58 | 4888 |
| 1208943 | N/A | N/A | 2226 | 2241 | CATGAGATAATGCCAT | 80 | 4889 |
| 1208968 | N/A | N/A | 2319 | 2334 | CTAGTTCAATGTTCAC | 62 | 4890 |
| 1208996 | N/A | N/A | 2336 | 2351 | GAACCTAATACTGTTT | 83 | 4891 |
| 1209021 | N/A | N/A | 2388 | 2403 | ACCAGATTATATGCTG | 43 | 4892 |
| 1209047 | N/A | N/A | 2460 | 2475 | CATCAGCTTAGCATTG | 36 | 4893 |
| 1209072 | N/A | N/A | 2492 | 2507 | TAGACACTTGATTCAG | 33 | 4894 |
| 1209097 | N/A | N/A | 2544 | 2559 | AGCTGTGTAGTTCCTA | 82 | 4895 |
| 1209123 | N/A | N/A | 2646 | 2661 | AATGAGTGTCCTTCTC | 135 | 4896 |
| 1209151 | N/A | N/A | 2706 | 2721 | TTCCCAGTTAAGGTTC | 75 | 4897 |

TABLE 75-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209177 | N/A | N/A | 2748 | 2763 | GGCCATTTGTGGGCAT | 63 | 4898 |
| 1209204 | N/A | N/A | 2784 | 2799 | TTGTAACTCCCAAGTC | 55 | 4899 |
| 1209227 | N/A | N/A | 2816 | 2831 | CATTGAGAATGTGCCT | 37 | 4900 |
| 1209250 | N/A | N/A | 2870 | 2885 | CTGTAAAACGGCAGTA | 45 | 4901 |
| 1209276 | N/A | N/A | 2956 | 2971 | ACTTGCCACAAAGTAG | 76 | 4902 |
| 1209300 | N/A | N/A | 3017 | 3032 | CTCCACAACCTGCTAG | 32 | 4903 |
| 1209328 | N/A | N/A | 3370 | 3385 | AAAAGTTGGGTTCAGG | 43 | 4904 |
| 1209346 | N/A | N/A | 3425 | 3440 | GGAAAAGGACAGACCC | 35 | 4905 |
| 1209359 | N/A | N/A | 3473 | 3488 | CTTCCCCTGTACTCAA | 72 | 4906 |
| 1209372 | N/A | N/A | 3503 | 3518 | GAACTGCAGGGACAAC | 62 | 4907 |
| 1209385 | N/A | N/A | 3656 | 3671 | ACAGGCAGGGTACATG | 43 | 4908 |
| 1209398 | N/A | N/A | 3702 | 3717 | CCTATCACAGTCCCCT | 51 | 4909 |
| 1209411 | N/A | N/A | 3878 | 3893 | ATGAGGCGGGAGGAGA | 37 | 4910 |
| 1209424 | N/A | N/A | 3919 | 3934 | AGAATCCCAGGTGTGT | 50 | 4911 |
| 1209437 | N/A | N/A | 3997 | 4012 | AAATGGGACCACTCCT | 114 | 4912 |
| 1209450 | N/A | N/A | 4028 | 4043 | CAAGTTTCCAAGCTTG | 90 | 4913 |
| 1209463 | N/A | N/A | 4065 | 4080 | CCTTCTTGAACCTACT | 65 | 4914 |
| 1209476 | N/A | N/A | 4266 | 4281 | CCGCCCAGGTCCTCCA | 60 | 4915 |
| 1209489 | N/A | N/A | 4329 | 4344 | CAAGTCTCCGAGTATC | 71 | 4916 |
| 1209502 | N/A | N/A | 4354 | 4369 | GTCTCAGGAGAGTCTA | 43 | 4917 |
| 1209515 | N/A | N/A | 4608 | 4623 | GACCCCCCCAGAGAGC | 107 | 4918 |
| 1209528 | N/A | N/A | 4773 | 4788 | TTGCCCCAGACCCTCA | 70 | 4919 |
| 1209541 | N/A | N/A | 5118 | 5133 | CGCCGGGAGCCCGGAG | 80 | 4920 |
| 1209554 | N/A | N/A | 5427 | 5442 | GGCCGGAATCTAGCTC | 41 | 4921 |
| 1209567 | N/A | N/A | 5714 | 5729 | CGGGTACTCGCCGGTC | 58 | 4922 |
| 1209580 | N/A | N/A | 5847 | 5862 | TCCTCCCCGGGAGCTC | 64 | 4923 |
| 1209593 | N/A | N/A | 6094 | 6109 | CGCCCCACGCACCCA | 92 | 4924 |
| 1209606 | N/A | N/A | 6356 | 6371 | TGATCAAAGGTCTCCT | 31 | 4925 |
| 1209619 | N/A | N/A | 6435 | 6450 | AACCCATCAGGTCAGC | 43 | 4926 |
| 1209632 | N/A | N/A | 6473 | 6488 | CCTGGGATTCTACCTG | 29 | 4927 |
| 1209645 | N/A | N/A | 6528 | 6543 | TCGATTCTCCCTGTAT | 28 | 4928 |
| 1209658 | N/A | N/A | 6617 | 6632 | GAACCTGGCTCCCACA | 55 | 4929 |
| 1209671 | N/A | N/A | 6679 | 6694 | CAGGATTTGAATGGGC | 31 | 4930 |
| 1209684 | N/A | N/A | 6779 | 6794 | AAACCCACTCATGCCC | 39 | 4931 |
| 1209697 | N/A | N/A | 6837 | 6852 | ACCCCATCTGACAACG | 65 | 4932 |

TABLE 75-continued

Reduction of FXII RNA by 3-10-3 cEt gapmers with uniform PS internucleoside linkages (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FXII (% UTC) | SEQ ID NO |
|---|---|---|---|---|---|---|---|
| 1209710 | N/A | N/A | 7025 | 7040 | GCTAAGAGCTCACCTG | 86† | 4933 |
| 1209723 | N/A | N/A | 7108 | 7123 | ATCACCCTGGGTCGGA | 68† | 4934 |

TABLE 76

Reduction of FXII RNA by 3-10-3 cEt gapmers with uniform PS internucleoside linkages (Huh7, electroporation, 3000 nM modified oligonucleotide)

| Compound Number | SEQ ID NO: 3 Start Site | SEQ ID NO: 3 Stop Site | SEQ ID NO: 4 Start Site | SEQ ID NO: 4 Stop Site | Sequence (5' to 3') | FXII (% UTC) | SEQ ID NO |
|---|---|---|---|---|---|---|---|
| 1128718 | 3437 | 3452 | 13 | 28 | CTGCCTATCCAGGAGT | 69 | 4935 |
| 1128719 | 3439 | 3454 | 15 | 30 | AGCTGCCTATCCAGGA | 33 | 4936 |
| 1128720 | 3449 | 3464 | 25 | 40 | CCGTTGGTCCAGCTGC | 22 | 4937 |
| 1128721 | 3450 | 3465 | 26 | 41 | TCCGTTGGTCCAGCTG | 49 | 4938 |
| 1128726 | 3459 | 3474 | 35 | 50 | TGGCATCCGTCCGTTG | 60 | 4939 |
| 1128727 | 3460 | 3475 | 36 | 51 | ATGGCATCCGTCCGTT | 60 | 4940 |
| 1128728 | 3463 | 3478 | 39 | 54 | CTCATGGCATCCGTCC | 66 | 4941 |
| 1128729 | 3464 | 3479 | 40 | 55 | CCTCATGGCATCCGTC | 85 | 4942 |
| 1128730 | 3465 | 3480 | 41 | 56 | CCCTCATGGCATCCGT | 72 | 4943 |
| 1128731 | 3468 | 3483 | 44 | 59 | GAGCCCTCATGGCATC | 60 | 4944 |

TABLE 77

Reduction of FXII RNA by 3-10-3 cEt gapmers with uniform PS internucleoside linkages (Huh7, electroporation, 3000 nM modified oligonucleotide)

| Compound Number | SEQ ID NO: 3 Start Site | SEQ ID NO: 3 Stop Site | SEQ ID NO: 4 Start Site | SEQ ID NO: 4 Stop Site | Sequence (5' to 3') | FXII (% UTC) | SEQ ID NO |
|---|---|---|---|---|---|---|---|
| 1128724 | 3455 | 3470 | 31 | 46 | ATCCGTCCGTTGGTCC | 42 | 4945 |
| 1128725 | 3457 | 3472 | 33 | 48 | GCATCCGTCCGTTGGT | 59 | 4946 |

Example 4: Effects of Modified Oligonucleotides with Mixed Sugar Modifications and Mixed Backbones on Human FXII RNA In Vitro, Single Dose Modified oligonucleotides complementary to an FXII nucleic acid were synthesized and tested for their effect on FXII RNA levels in vitro. The modified oligonucleotides were tested in a series of experiments using similar culture conditions. The results for each separate experiment are presented in separate tables below.

The chemistry notation column in the tables below specifies the specific chemistry notation for modified oligonucleotides; wherein subscript 'd' represents a 2'-β-D-deoxyribosyl sugar moiety, subscript 'e' represents a 2'-MOE sugar moiety, subscript 'y' represents a 2-O-methyl sugar moiety, subscript 'k' represents a cEt modified sugar moiety, subscript 's' represents a phosphorothioate internucleoside linkage, subscript 'o' represents a phosphodiester internucleoside linkage, and superscript 'm' before the cytosine residue ($^m$C) represents a 5-methyl cytosine.

"Start site" indicates the 5'-most nucleoside of the target sequence to which the modified oligonucleotide is complementary. "Stop site" indicates the 3'-most nucleoside of the target sequence to which the modified oligonucleotide is complementary. As shown in the tables below, the modified oligonucleotides are 100% complementary to one or more of human FXII target sequences including the human FXII mRNA sequence designated herein as SEQ ID NO: 1 (ENSEMBL ID ENST00000253496.3 from ENSEMBL version 99: January 2020), the human FXII genomic sequence, designated herein as SEQ ID NO: 2 (ENSEMBL ID ENSG00000131187.9 from ENSEML version 99: January 2020, human reference assembly version GRCh38.p13 located on the reverse strand of chromosome 5 from positions 177,402,140 to 177,409,576), the human FXII genomic sequence, designated herein as SEQ ID No. 3 (the complement of GENBANK Accession No. NC_000005.10 truncated from truncated from nucleotides 177399001 to 177413000), and the human FXII mRNA sequence designated herein as SEQ ID No: 4 (GENBANK Accession No. NM_0005053), 'N/A' indicates that the modified oligonucleotide is not complementary to that particular target sequence with 100% complementarity.

Cultured Huh7 cells, at a density of 20,000 cells per well, were transfected using electroporation with either 2000 nM or 4000 nM modified oligonucleotide. After a treatment period of approximately 24 hours, RNA was isolated from the cells and FXII RNA levels were measured by quantitative real-time RTPCR. Human primer probe set RTS40528 (described herein above) was used to measure RNA levels. FXII RNA levels were normalized to total RNA content, as measured by RIBOGREEN®. Reduction of FXII RNA is presented in the tables below as percent FXII RNA relative to the amount in untreated control cells (% UTC). The symbol "†" indicates that the modified oligonucleotide is complementary to the target transcript within the amplicon region of the primer probe set. In such instances, additional assays using alternative primer probes must be performed to accurately assess the potency and efficacy of such modified oligonucleotides.

TABLE 78

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence with Chemistry notation (5' to 3') | FXII (% UTC) | SEQ ID NO |
|---|---|---|---|---|---|---|---|
| 1129531 | 2009 | 2024 | 7397 | 7412 | $G_{ks}A_{ks}G_{ks}T_{ds}T_{ds}{}^mC_{ds}C_{ds}T_{ds}G_{ds}{}^mC_{ds}G_{ds}{}^mC_{ds}{}^mC_{ds}A_{ks}T_{ks}{}^mC_k$ | 44 | 3837 |
| 1206480 | 1782 | 1797 | 7170 | 7185 | $A_{ks}T_{ks}G_{ks}{}^mC_{ds}{}^mC_{ds}T_{ds}T_{ds}G_{ds}{}^mC_{ds}A_{ds}G_{ds}G_{ds}G_{ds}T_{ks}G_{ks}A_k$ | 60 | 4947 |
| 1206486 | 1915 | 1930 | 7303 | 7318 | $T_{ks}{}^mC_{ks}A_{ks}{}^mC_{ds}{}^mC_{ds}A_{ds}A_{ds}G_{ds}G_{ds}A_{ds}G_{ds}G_{ds}G_{ds}A_{ks}A_{ks}A_k$ | 59 | 4948 |
| 1206491 | 1934 | 1949 | 7322 | 7337 | ${}^mC_{ks}{}^mC_{ks}A_{ks}{}^mC_{ds}T_{ds}{}^mC_{ds}T_{ds}{}^mC_{ds}T_{ds}{}^mC_{ds}A_{ds}{}^mC_{ds}T_{ds}G_{ks}{}^mC_{ks}G_k$ | 64 | 4949 |
| 1206495 | 141 | 156 | 508 | 523 | $T_{ks}G_{ks}{}^mC_{ks}T_{ds}{}^mC_{ds}T_{ds}T_{ds}{}^mC_{ds}A_{ds}G_{ds}{}^mC_{ds}T_{ds}T_{ds}T_{ks}G_{ks}T_k$ | 64 | 4950 |
| 1206901 | 144 | 159 | 511 | 526 | $G_{ks}T_{es}G_{ks}T_{ds}G_{ds}{}^mC_{ds}T_{ds}{}^mC_{ds}T_{ds}T_{ds}{}^mC_{ds}T_{ds}G_{es}{}^mC_{es}T_{ks}C_k$ | 81 | 4951 |
| 1206909 | 152 | 167 | N/A | N/A | $G_{ks}A_{es}A_{ks}{}^mC_{ds}G_{ds}A_{ds}{}^mC_{ds}T_{ds}G_{ds}T_{ds}G_{ds}T_{ds}G_{es}{}^mC_{es}T_{ks}{}^mC_k$ | 53 | 3647 |
| 1206917 | 209 | 224 | 3560 | 3575 | $G_{ks}G_{es}T_{ks}A_{ds}{}^mC_{ds}A_{ds}G_{ds}{}^mC_{ds}T_{ds}G_{ds}{}^mC_{ds}{}^mC_{ds}G_{es}G_{es}T_{ks}G_k$ | 42 | 4952 |
| 1206925 | 217 | 232 | 3568 | 3583 | $A_{ks}{}^mC_{es}A_{ks}T_{ds}T_{ds}T_dG_{ds}T_dG_{ds}G_{ds}T_{ds}A_{ds}{}^mC_{es}A_{es}G_{ks}{}^mC_k$ | 64 | 3114 |
| 1206933 | 1777 | 1792 | 7165 | 7180 | $T_{ks}T_{es}G_{ks}{}^mC_{ds}A_{ds}G_{ds}G_{ds}G_{ds}T_{ds}G_{ds}A_{ds}G_{ds}{}^mC_{es}{}^mC_{es}G_{ks}G_k$ | 62 | 3375 |
| 1206941 | 1785 | 1800 | 7173 | 7188 | $A_{ks}T_{es}G_{ks}A_{ds}T_{ds}G_{ds}{}^mC_d{}^mC_{ds}T_{ds}T_{ds}G_{ds}{}^mC_{ds}A_{es}G_{es}G_{ks}G_k$ | 57 | 3603 |
| 1206949 | 1793 | 1808 | 7181 | 7196 | ${}^mC_{ks}{}^mC_{es}{}^mC_{ks}A_{ds}G_{ds}{}^mC_{ds}T_{ds}G_{ds}A_{ds}T_{ds}G_{ds}A_{ds}T_{es}G_{es}{}^mC_{ks}{}^mC_k$ | 64 | 4953 |
| 1206957 | 1899 | 1914 | 7287 | 7302 | $G_{ks}A_{es}T_{ks}G_{ds}A_{ds}G_{ds}T_{ds}{}^mC_{ds}{}^mC_{ds}{}^mC_{ds}T_{ds}G_{ds}A_{es}G_{es}{}^mC_{ks}A_k$ | 47 | 2537 |
| 1206965 | 1914 | 1929 | 7302 | 7317 | ${}^mC_{ks}A_{es}{}^mC_{ks}{}^mC_{ds}A_{ds}A_{ds}G_{ds}G_{ds}A_{ds}G_{ds}G_{ds}G_{ds}A_{es}A_{es}A_{ks}G_k$ | 60 | 4954 |

TABLE 78-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence with Chemistry notation (5' to 3') | FXII (% UTC) | SEQ ID NO |
|---|---|---|---|---|---|---|---|
| 1206973 | 1922 | 1937 | 7310 | 7325 | $T_{ks}G_{es}{}^mC_{ks}G_{ds}G_{ds}A_{ds}A_{ds}T_{ds}{}^mC_{ds}A_{ds}{}^mC_{ds}{}^mC_{ds}A_{es}A_{es}G_{ks}G_k$ | 62 | 3455 |
| 1206981 | 1930 | 1945 | 7318 | 7333 | $T_{ks}{}^mC_{es}T_{ks}{}^mC_{ds}T_{ds}{}^mC_{ds}A_{ds}{}^mC_{ds}T_{ds}G_{ds}{}^mC_{ds}G_{ds}G_{es}A_{es}A_{ks}T_k$ | 50 | 4955 |
| 1206989 | 2000 | 2015 | 7388 | 7403 | ${}^mC_{ks}G_{es}{}^mC_{ks}{}^mC_{ds}A_{ds}T_{ds}{}^mC_{ds}{}^mC_{ds}T_{ds}G_{ds}G_{ds}{}^mC_{ds}G_{es}{}^mC_{es}G_{ks}G_k$ | 91 | 3228 |
| 1206997 | 2008 | 2023 | 7396 | 7411 | $A_{ks}G_{es}T_{ks}T_{ds}{}^mC_{ds}{}^mC_{ds}T_{ds}G_{ds}{}^mC_{ds}G_{ds}{}^mC_{ds}{}^mC_{ds}A_{es}T_{es}{}^mC_{ks}{}^mC_k$ | 38 | 3761 |
| 1207005 | 2017 | 2032 | 7405 | 7420 | $A_{ks}{}^mC_{es}T_{ks}T_{ds}T_{ds}A_{ds}T_{ds}T_{ds}G_{ds}A_{ds}G_{ds}T_{ds}T_{es}{}^mC_{es}{}^mC_{ks}T_k$ | 41 | 2848 |
| 1207013 | 2031 | 2046 | 7419 | 7434 | $A_{ks}G_{es}{}^mC_{ks}A_{ds}T_{ds}T_{ds}T_{ds}T_{ds}{}^mC_{ds}A_{ds}A_{ds}A_{ds}G_{es}{}^mC_{es}A_{ks}{}^mC_k$ | 106 | 3458 |
| 1207032 | 147 | 162 | 514 | 529 | $A_{ks}{}^mC_{ks}T_{ds}G_{ds}T_{ds}G_{ds}T_{ds}G_{ds}{}^mC_{ds}T_{ds}{}^mC_{ds}T_{es}T_{es}{}^mC_{es}A_{ks}G_k$ | 51 | 3267 |
| 1207040 | 155 | 170 | N/A | N/A | $T_{ks}G_{ks}A_{ds}G_{ds}A_{ds}A_{ds}{}^mC_{ds}G_{ds}A_{ds}{}^mC_{ds}T_{ds}G_{es}T_{es}G_{es}T_{ks}G_k$ | 71 | 3875 |
| 1207048 | 212 | 227 | 3563 | 3578 | $T_{kS}G_{kS}T_{ds}G_{ds}G_{ds}T_{ds}A_{ds}{}^mC_{ds}A_{ds}G_{ds}{}^mC_{ds}T_{es}G_{es}{}^mC_{es}{}^mC_{ks}C_k$ | 63 | 2734 |
| 1207056 | 220 | 235 | 3571 | 3586 | $G_{ks}G_{ks}T_{ds}A_{ds}{}^mC_{ds}A_{ds}T_{ds}T_{ds}T_{ds}G_{ds}T_{ds}G_{es}G_{es}T_{es}A_{ks}{}^mC_k$ | 66 | 3269 |
| 1207064 | 1780 | 1795 | 7168 | 7183 | $G_{ks}{}^mC_{ks}{}^mC_{ds}T_{ds}T_{dsds}{}^mC_{ds}A_{dsdsds}G_{ds}T_{es}G_{es}A_eG_{ks}{}^mC_k$ | 58 | 3451 |
| 1207085 | 1788 | 1803 | 7176 | 7191 | ${}^mC_{ks}T_{ks}G_{ds}A_{ds}T_{ds}G_{ds}A_{ds}T_{ds}G_{ds}{}^mC_{ds}{}^mC_{ds}T_{es}T_{es}G_{es}{}^mC_{ks}A_k$ | 61 | 3679 |
| 1207093 | 1894 | 1909 | 7282 | 7297 | ${}^mC_{ks}A_{ks}{}^mC_{ds}T_{ds}G_{ds}{}^mC_{ds}G_{ds}G_{ds}A_{ds}A_{ds}A_{ds}A_{es}T_{es}{}^mC_{es}A_{ks}G_k$ | 56 | 3682 |
| 1207101 | 1902 | 1917 | 7290 | 7305 | $A_{ks}A_{ks}A_{ds}G_{ds}A_{ds}T_{ds}G_{ds}A_{ds}G_{ds}T_{ds}{}^mC_{ds}{}^mC_{es}{}^mC_{es}T_{es}G_{ks}A_k$ | 48 | 2768 |
| 1207109 | 1917 | 1932 | 7305 | 7320 | $A_{ks}A_{ks}T_{ds}{}^mC_{ds}A_{ds}{}^mC_{ds}{}^mC_{ds}A_{ds}A_{ds}G_{ds}G_{ds}A_{es}G_{es}G_{es}G_{ks}A_k$ | 42 | 4956 |
| 1207117 | 1925 | 1940 | 7313 | 7328 | ${}^mC_{ks}A_{kS}{}^mC_{ds}T_{ds}G_{ds}{}^mC_{ds}G_{ds}G_{ds}G_{ds}A_{ds}A_{ds}T_{ds}{}^mC_{es}A_{es}{}^mC_{es}{}^mC_{ks}A_k$ | 56 | 3683 |
| 1207133 | 1933 | 1948 | 7321 | 7336 | ${}^mC_{ks}A_{ks}{}^mC_{ds}T_{ds}{}^mC_{ds}T_{ds}{}^mC_{ds}T_{ds}{}^mC_{ds}A_{ds}{}^mC_{ds}T_{es}G_{es}{}^mC_{es}G_{ks}G_k$ | 33 | 4957 |
| 1207146 | 2003 | 2018 | 7391 | 7406 | ${}^mC_{ks}T_{ks}G_{ds}{}^mC_{ds}G_{ds}{}^mC_{ds}{}^mC_{ds}A_{ds}T_{ds}{}^mC_{ds}{}^mC_{ds}T_{es}G_{es}G_{es}{}^mC_{ks}G_k$ | 76 | 3381 |
| 1207154 | 2011 | 2026 | 7399 | 7414 | $T_{ks}T_{kS}G_{ds}A_{ds}G_{ds}T_{ds}T_{ds}{}^mC_{ds}{}^mC_{ds}T_{ds}G_{ds}{}^mC_{es}G_{es}{}^mC_{es}{}^mC_{ks}A_k$ | 48 | 2463 |
| 1207162 | 2020 | 2035 | 7408 | 7423 | $A_{ks}G_{ks}{}^mC_{ds}A_{ds}{}^mC_{ds}T_{ds}T_{ds}T_{ds}A_{ds}T_{ds}T_{ds}G_{es}A_{es}G_{es}T_{ks}T_k$ | 55 | 3076 |
| 1207170 | 142 | 157 | 509 | 524 | $g_{ks}T_{ks}G_{ds}{}^mC_{ds}T_{ds}{}^mC_{ds}T_{ds}T_{ds}{}^mC_{ds}A_{ds}G_{ds}{}^mC_{es}T_{ks}T_{es}T_{ks}G_e$ | 47 | 4958 |
| 1207178 | 150 | 165 | N/A | N/A | $A_{ks}{}^mC_{ks}G_{ds}A_{ds}{}^mC_{ds}T_{ds}G_{ds}T_{ds}G_{ds}T_{ds}G_{ds}{}^mC_{es}T_{ks}{}^mC_{es}T_{ks}T_e$ | 50 | 3495 |
| 1207186 | 158 | 173 | N/A | N/A | ${}^mC_{ks}A_{ks}G_{ds}T_{dS}G_{ds}A_{ds}G_{ds}A_{ds}A_{ds}{}^mC_{ds}G_{ds}A_{es}{}^mC_{ks}T_{es}G_{ks}T_e$ | 78 | 2579 |

TABLE 78-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence with Chemistry notation (5' to 3') | FXII (% UTC) | SEQ ID NO |
|---|---|---|---|---|---|---|---|
| 1207194 | 215 | 230 | 3566 | 3581 | $A_{ks}T_{ks}T_{ds}T_{d}G_{ds}T_{ds}G_{ds}G_{ds}T_{ds}A_{ds}C_{ds}A_{es}G_{ks}{}^mC_{es}T_{ks}G_e$ | 70 | 2963 |
| 1207202 | 223 | 238 | 3574 | 3589 | $G_{ks}T_{ks}G_{ds}G_{ds}G_{ds}T_{ds}A_{ds}{}^mC_{ds}A_{ds}T_{ds}T_{ds}T_{es}G_{ks}T_{es}G_{ks}G_e$ | 36 | 3497 |
| 1207210 | 1783 | 1798 | 7171 | 7186 | $G_{ks}A_{ks}T_{ds}G_{ds}{}^mC_{ds}{}^mC_{ds}T_{ds}T_{ds}G_{ds}{}^mC_{ds}A_{ds}G_{es}G_{ks}G_{es}T_{ks}G_e$ | 39 | 4959 |
| 1207218 | 1791 | 1806 | 7179 | 7194 | ${}^mC_{ks}A_{ks}G_{ds}{}^mC_{ds}T_{ds}G_{ds}A_{ds}T_{ds}G_{ds}A_{ds}T_{ds}G_{es}{}^mC_{ks}{}^mC_{es}T_{ks}T_e$ | 89 | 4960 |
| 1207226 | 1897 | 1912 | 7285 | 7300 | $T_{ks}G_{ks}A_{ds}G_{ds}T_{ds}{}^mC_{ds}{}^mC_{ds}{}^mC_{ds}T_{ds}G_{ds}A_{ds}G_{es}{}^mC_{ks}A_{es}A_{ks}T_e$ | 65 | 3910 |
| 1207234 | 1905 | 1920 | 7293 | 7308 | $G_{ks}G_{ks}G_{ds}A_{ds}A_{ds}A_{ds}G_{ds}A_{ds}T_{ds}G_{ds}A_{ds}G_{es}T_{ks}{}^mC_{es}{}^mC_{ks}{}^mC_e$ | 68 | 2997 |
| 1207242 | 1920 | 1935 | 7308 | 7323 | ${}^mC_{ks}G_{ks}G_{ds}A_{ds}A_{ds}T_{ds}{}^mC_{ds}A_{ds}{}^mC_{ds}{}^mC_{ds}A_{ds}A_{es}G_{ks}G_{es}A_{ks}G_e$ | 26 | 3303 |
| 1207250 | 1928 | 1943 | 7316 | 7331 | $T_{ks}{}^mC_{ks}T_{ds}{}^mC_{ds}A_{ds}{}^mC_{ds}T_{ds}G_{ds}{}^mC_{ds}G_{ds}G_{ds}A_{es}A_{ks}T_{es}{}^mC_{ks}A_e$ | 31 | 3911 |
| 1207258 | 1936 | 1951 | 7324 | 7339 | $A_{ks}G_{ks}{}^mC_{ds}{}^mC_{ds}A_{ds}{}^mC_{ds}T_{ds}{}^mC_{ds}T_{ds}{}^mC_{ds}T_{ds}{}^mC_{es}A_{ks}{}^mC_{es}T_{ks}G_e$ | 29 | 4961 |
| 1207266 | 2006 | 2021 | 7394 | 7409 | $T_{ks}T_{ks}{}^mC_{ds}{}^mC_{ds}T_{ds}G_{ds}{}^mC_{ds}G_{ds}{}^mC_{ds}{}^mC_{ds}A_{ds}T_{es}{}^mC_{ks}{}^mC_{es}T_{ks}G_e$ | 70 | 3609 |
| 1207274 | 2014 | 2029 | 7402 | 7417 | $T_{ks}T_{ks}A_{ds}T_{d}T_{d}G_{ds}A_{ds}G_{ds}T_{ds}T_{ds}{}^mC_{ds}{}^mC_{es}T_{ks}G_{es}{}^mC_{ks}G_e$ | 54 | 2694 |
| 1207282 | 2023 | 2038 | 7411 | 7426 | ${}^mC_{ks}A_{ks}A_{ds}A_{ds}G_{ds}{}^mC_{ds}A_{ds}{}^mC_{ds}T_{ds}T_{ds}T_{ds}A_{es}T_{ks}T_{es}G_{ks}A_e$ | 68 | 3306 |
| 1207290 | 145 | 160 | 512 | 527 | $T_{ks}G_{ks}T_{ds}G_{ds}T_{ds}G_{ds}{}^mC_{ds}T_{ds}{}^mC_{ds}T_{ds}T_{ds}{}^mC_{ks}A_{es}G_{ks}{}^mC_{es}T_k$ | 74 | 3112 |
| 1207298 | 153 | 168 | N/A | N/A | $A_{ks}G_{ks}A_{ds}A_{ds}{}^mC_{ds}G_{ds}A_{ds}{}^mC_{ds}T_{ds}G_{ds}T_{ds}G_{ks}T_{es}G_{ks}{}^mC_{es}T_k$ | 52 | 3723 |
| 1207306 | 210 | 225 | 3561 | 3576 | $T_{ks}G_{ks}G_{ds}T_{ds}A_{ds}{}^mC_{ds}A_{ds}G_{ds}{}^mC_{ds}T_{ds}G_{ds}{}^mC_{ks}{}^mC_{es}G_{ks}G_{es}T_k$ | 91 | 2657 |
| 1207314 | 218 | 233 | 3569 | 3584 | $T_{ks}A_{ks}{}^mC_{ds}A_{ds}T_{ds}T_{ds}T_{ds}G_{ds}T_{ds}G_{ds}G_{ds}T_{ks}A_{es}{}^mC_{ks}A_{es}G_k$ | 66 | 2426 |
| 1207322 | 1778 | 1793 | 7166 | 7181 | ${}^mC_{ks}T_{ks}T_{ds}G_{ds}{}^mC_{ds}A_{ds}G_{ds}G_{ds}G_{ds}T_{ds}G_{ds}A_{ks}G_{es}{}^mC_{ks}{}^mC_{es}G_k$ | 59 | 4962 |
| 1207330 | 1786 | 1801 | 7174 | 7189 | $G_{ks}A_{ks}T_{ds}G_{ds}A_{ds}T_{d}G_{ds}{}^mC_{ds}{}^mC_{ds}T_{ds}T_{ds}G_{ks}{}^mC_{es}A_{ks}G_{es}G_k$ | 53 | 4963 |
| 1207338 | 1892 | 1907 | 7280 | 7295 | ${}^mC_{ks}{}^mC_{ks}{}^mC_{ds}T_{ds}G_{ds}A_{ds}G_{ds}{}^mC_{ds}A_{ds}A_{ds}T_{ds}{}^mC_{ks}A_{es}G_{ks}G_{es}A_k$ | 74 | 3530 |
| 1207346 | 1900 | 1915 | 7288 | 7303 | $A_{ks}G_{ks}A_{ds}T_{ds}G_{ds}G_{ds}A_{d}G_{ds}T_{ds}{}^mC_{ds}{}^mC_{ds}{}^mC_{ds}T_{ks}G_{es}A_{ks}G_{es}{}^mC_k$ | 76 | 2614 |
| 1207354 | 1915 | 1930 | 7303 | 7318 | $T_{ks}{}^mC_{ks}A_{ds}{}^mC_{ds}{}^mC_{ds}A_{ds}A_{ds}G_{ds}G_{ds}A_{ds}G_{ds}G_{ks}G_{es}A_{ks}A_{es}A_k$ | 44 | 4948 |
| 1207362 | 1923 | 1938 | 7311 | 7326 | ${}^mC_{ks}T_{ks}G_{ds}{}^mC_{ds}G_{ds}G_{ds}A_{ds}A_{ds}T_{ds}{}^mC_{ds}A_{ds}{}^mC_{ks}{}^mC_{es}A_{ks}A_{es}G_k$ | 46 | 3531 |
| 1207370 | 1931 | 1946 | 7319 | 7334 | ${}^mC_{ks}T_{ks}{}^mC_{ds}T_{ds}{}^mC_{ds}T_{ds}{}^mC_{ds}A_{ds}{}^mC_{ds}T_{ds}G_{ds}{}^mC_{ks}G_{es}G_{ks}A_{es}A_k$ | 41 | 2461 |

TABLE 78-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence with Chemistry notation (5' to 3') | FXII (% UTC) | SEQ ID NO |
|---|---|---|---|---|---|---|---|
| 1207378 | 2001 | 2016 | 7389 | 7404 | $G_{ks}{}^mC_{ds}G_{ds}{}^mC_{ds}{}^mC_{ds}A_{ds}T_{ds}{}^mC_{ds}{}^mC_{ds}T_{ds}G_{ds}G_{ks}{}^mC_{es}G_{ks}{}^mC_{es}G_{k}$ | 80 | 4964 |
| 1207386 | 2009 | 2024 | 7397 | 7412 | $G_{ks}A_{ks}G_{ds}T_{ds}T_{ds}{}^mC_{ds}{}^mC_{ds}T_{ds}G_{ds}{}^mC_{ds}G_{ds}{}^mC_{ks}{}^mC_{es}A_{ks}T_{es}{}^mC_{k}$ | 71 | 3837 |
| 1207394 | 2018 | 2033 | 7406 | 7421 | ${}^mC_{ks}A_{ks}{}^mC_{ds}T_{ds}T_{ds}T_{ds}A_{ds}T_{ds}T_{ds}G_{ds}A_{ds}G_{ks}T_{es}T_{ks}{}^mC_{es}{}^mC_{k}$ | 47 | 2924 |
| 1207402 | 2033 | 2048 | 7421 | 7436 | $T_{ks}{}^mC_{ks}A_{ds}G_{ds}{}^mC_{ds}A_{ds}T_{ds}T_{ds}T_{ds}{}^mC_{ds}A_{ks}A_{es}A_{ks}G_{es}{}^mC_{k}$ | 32 | 3534 |
| 1207410 | 148 | 163 | 515 | 530 | $G_{ks}A_{ks}{}^mC_{ks}T_{ds}G_{ds}T_{ds}G_{ds}T_{ds}G_{ds}{}^mC_{ds}T_{ds}{}^mC_{ds}T_{ks}T_{ks}{}^mC_{ks}A_{e}$ | 64 | 3343 |
| 1207418 | 156 | 171 | N/A | N/A | $G_{ks}T_{ks}G_{ks}A_{ds}G_{ds}A_{ds}A_{ds}{}^mC_{ds}G_{ds}A_{ds}{}^mC_{ds}T_{ds}G_{ks}T_{ks}G_{ks}T_{e}$ | 88 | 2424 |
| 1207426 | 213 | 228 | 3564 | 3579 | $T_{ks}T_{ks}G_{ks}T_{ds}G_{ds}G_{ds}T_{ds}A_{ds}{}^mC_{ds}A_{ds}G_{ds}{}^mC_{ds}T_{ks}G_{ks}{}^mC_{ks}{}^mC_{e}$ | 54 | 2.811 |
| 1207434 | 221 | 236 | 3572 | 3587 | $G_{ks}G_{ks}G_{ks}T_{ds}A_{ds}{}^mC_{ds}A_{ds}T_{ds}T_{ds}T_{ds}G_{ds}T_{ds}G_{ks}G_{ks}T_{ks}A_{e}$ | 63 | 3345 |
| 1207442 | 1781 | 1796 | 7169 | 7184 | $T_{ksks}{}^mC_{ks}{}^mC_{ds}T_{ds}T_{ds}{}^mC_{dsds}{}^mC_{ds}A_{ds}G_{ds}G_{ds}G_{ds}T_{ks}G_{ks}A_{ks}G_{e}$ | 70 | 3527 |
| 1207450 | 1789 | 1804 | 7177 | 7192 | $G_{ks}{}^mC_{ks}T_{ks}G_{ds}A_{ds}T_{ds}G_{ds}A_{ds}A_{ds}T_{ds}G_{ds}{}^mC_{ds}{}^mC_{ds}T_{ks}T_{ks}G_{ks}{}^mC_{e}$ | 67 | 3755 |
| 1207458 | 1895 | 1910 | 7283 | 7298 | $A_{ks}G_{ks}T_{ks}{}^mC_{ds}{}^mC_{ds}{}^mC_{ds}T_{ds}G_{ds}A_{ds}G_{ds}{}^mC_{ds}A_{ds}T_{ks}{}^mC_{ks}A_{e}$ | 51 | 3758 |
| 1207466 | 1903 | 1918 | 7291 | 7306 | $G_{ks}A_{ks}A_{ks}A_{ds}G_{ds}A_{ds}T_{ds}G_{ds}A_{ds}G_{ds}T_{ds}{}^mC_{ds}{}^mC_{ks}{}^mC_{ks}T_{ks}G_{e}$ | 36 | 2845 |
| 1207474 | 1918 | 1933 | 7306 | 7321 | $G_{ks}A_{ks}A_{ks}T_{ds}{}^mC_{ds}A_{ds}{}^mC_{ds}{}^mC_{ds}A_{ds}A_{ds}G_{ds}G_{ds}A_{ks}G_{ks}G_{ks}G_{e}$ | 36 | 4965 |
| 1207482 | 1926 | 1941 | 7314 | 7329 | $T_{ks}{}^mC_{ks}A_{ks}{}^mC_{ds}T_{ds}G_{ds}{}^mC_{ds}G_{ds}G_{ds}G_{ds}A_{ds}A_{ds}T_{ds}{}^mC_{ks}A_{ks}{}^mC_{k}{}^mC_{e}$ | 50 | 3759 |
| 1207490 | 1934 | 1949 | 7322 | 7337 | ${}^mC_{ks}{}^mC_{ks}A_{ks}{}^mC_{ds}T_{ds}{}^mC_{ds}T_{ds}{}^mC_{ds}T_{ds}{}^mC_{ds}A_{ds}{}^mC_{ds}T_{ks}G_{ks}G_{ks}{}^mC_{e}$ | 38 | 4949 |
| 1207498 | 2004 | 2019 | 7392 | 7407 | ${}^mC_{ks}{}^mC_{ks}T_{ks}G_{ds}{}^mC_{ds}G_{ds}{}^mC_{ds}{}^mC_{ds}A_{ds}T_{ds}{}^mC_{ds}{}^mC_{ds}T_{ks}G_{ks}G_{ks}{}^mC_{e}$ | 54 | 3457 |
| 1207506 | 2012 | 2027 | 7400 | 7415 | $A_{ks}T_{ks}T_{ks}G_{ds}A_{ds}G_{ds}T_{ds}T_{ds}{}^mC_{ds}{}^mC_{ds}T_{ds}G_{ds}{}^mC_{ks}G_{ks}{}^mC_{ks}{}^mC_{e}$ | 66 | 2540 |
| 1207514 | 2021 | 2036 | 7409 | 7424 | $A_{ks}A_{ks}G_{ks}{}^mC_{ds}A_{ds}{}^mC_{ds}T_{ds}T_{ds}T_{ds}A_{ds}T_{ds}T_{ds}G_{ks}A_{ks}G_{ks}T_{e}$ | 42 | 3147 |

TABLE 79

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1129531 | 2009 | 2024 | 7397 | 7412 | $G_{ks}A_{ks}G_{ds}T_{ds}T_{ds}{}^mC_{ds}{}^mC_{ds}T_{ds}G_{ds}{}^mC_{ds}G_{ds}{}^mC_{ds}{}^mC_{ds}A_{ks}T_{ks}{}^mC_{k}$ | 21 | 3837 |

TABLE 79-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1206475 | 142 | 157 | 509 | 524 | $G_{ks}T_{ks}G_{ks}{}^mC_{ds}T_{ds}{}^mC_{ds}T_{ds}T_{ds}{}^mC_{ds}A_{ds}G_{ds}{}^mC_{ds}T_{ds}T_{ks}T_{ks}G_k$ | 32 | 4958 |
| 1206487 | 1916 | 1931 | 7304 | 7319 | $A_{ks}T_{ks}{}^mC_{ks}A_{ds}{}^mC_{ds}{}^mC_{ds}A_{ds}A_{ds}G_{ds}G_{ds}A_{ds}G_{ds}G_{ds}G_{ks}A_{ks}A_k$ | 33 | 4966 |
| 1206492 | 1935 | 1950 | 7323 | 7338 | $G_{ks}{}^mC_{ks}{}^mC_{ks}A_{ds}{}^mC_{ds}T_{ds}{}^mC_{ds}T_{ds}{}^mC_{ds}T_{ds}{}^mC_{ds}A_{ds}{}^mC_{ds}T_{ks}G_{ks}{}^mC_k$ | 5 | 4967 |
| 1206500 | 1783 | 1798 | 7171 | 7186 | $G_{ks}A_{ks}T_{ks}G_{ds}{}^mC_{ds}T_{ds}T_{ds}G_{ds}{}^mC_{ds}A_{ds}G_{ds}G_{ds}G_{ks}T_{ks}G_k$ | 22 | 4959 |
| 1206902 | 145 | 160 | 512 | 527 | $T_{ks}G_{es}T_{ks}G_{ds}T_{ds}{}^mC_{ds}T_{ds}{}^mC_{ds}T_{ds}T_{ds}C_{ds}A_{es}G_{es}{}^mC_{ks}T_k$ | 33 | 3112 |
| 1206910 | 153 | 168 | N/A | N/A | $A_{ks}G_{es}A_{ks}A_{ds}C_{ds}G_{ds}A_{ds}C_{ds}T_{ds}G_{ds}T_{ds}G_{ds}T_{es}G_{es}{}^mC_{ks}T_k$ | 39 | 3723 |
| 1206918 | 210 | 225 | 3561 | 3576 | $T_{ks}G_{es}G_{ks}T_{ds}A_{ds}{}^mC_{ds}A_{ds}G_{ds}{}^mC_{ds}T_{ds}G_{ds}{}^mC_{ds}{}^mC_{es}G_{es}G_{ks}T_k$ | 45 | 2657 |
| 1206926 | 218 | 233 | 3569 | 3584 | $T_{ks}A_{es}{}^mC_{ks}A_{ds}T_{ds}T_{ds}G_{ds}T_{ds}G_{ds}G_{ds}T_{ds}A_{es}{}^mC_{es}A_{ks}G_k$ | 17 | 2426 |
| 1206934 | 1778 | 1793 | 7166 | 7181 | ${}^mC_{ks}T_{es}T_{ks}G_{ds}{}^mC_{ds}A_{ds}G_{ds}G_{ds}G_{ds}T_{ds}G_{ds}A_{ds}G_{es}{}^mC_{es}{}^mC_{ks}G_k$ | 31 | 4962 |
| 1206942 | 1786 | 1801 | 7174 | 7189 | $G_{ks}A_{es}T_{ks}G_{ds}A_{ds}G_{ds}{}^mC_{ds}{}^mC_{ds}T_{ds}T_{ds}G_{ds}{}^mC_{es}A_{ks}G_{ks}G_k$ | 24 | 4963 |
| 1206950 | 1892 | 1907 | 7280 | 7295 | ${}^mC_{ks}{}^mC_{es}{}^mC_{ks}T_{ds}G_{ds}A_{ds}G_{ds}{}^mC_{ds}A_{ds}A_{ds}T_{ds}C_{ds}A_{es}G_{es}{}^mC_{ks}A_k$ | 47 | 3530 |
| 1206958 | 1900 | 1915 | 7288 | 7303 | $A_{ks}G_{es}A_{ks}T_{ds}G_{ds}A_{ds}G_{ds}T_{ds}C_{ds}C_{ds}C_{ds}T_{ds}G_{es}A_{es}G_{ks}{}^mC_k$ | 24 | 2614 |
| 1206966 | 1915 | 1930 | 7303 | 7318 | $T_{ks}{}^mC_{es}A_{ks}{}^mC_{ds}{}^mC_{ds}A_{ds}A_{ds}G_{ds}G_{ds}G_{ds}A_{ds}G_{ds}G_{ds}G_{es}A_{es}A_{ks}A_k$ | 24 | 4948 |
| 1206974 | 1923 | 1938 | 7311 | 7326 | ${}^mC_{ks}T_{es}G_{ks}{}^mC_{ds}G_{ds}G_{ds}G_{ds}A_{ds}A_{ds}T_{ds}{}^mC_{ds}A_{ds}{}^mC_{ds}{}^mC_{es}A_{es}A_{ks}G_k$ | 15 | 3531 |
| 1206982 | 1931 | 1946 | 7319 | 7334 | $C_{ks}T_{es}C_{ks}T_{ds}C_{ds}T_{ds}C_{ds}C_{ds}A_{ds}C_{ds}T_{ds}G_{ds}{}^mC_{ds}G_{es}G_{es}A_{ks}A_k$ | 17 | 2461 |
| 1206990 | 2001 | 2016 | 7389 | 7404 | $G_{ks}{}^mC_{es}G_{ks}{}^mC_{ds}{}^mC_{ds}A_{ds}T_{ds}{}^mC_{ds}{}^mC_{ds}T_{ds}G_{ds}G_{ds}{}^mC_{es}G_{es}{}^mC_{ks}G_k$ | 73 | 4964 |
| 1206998 | 2009 | 2024 | 7397 | 7412 | $G_{ks}A_{es}G_{ks}T_{ds}T_{ds}{}^mC_{ds}{}^mC_{ds}T_{ds}G_{ds}{}^mC_{ds}G_{ds}{}^mC_{ds}{}^mC_{es}A_{es}T_{ks}{}^mC_k$ | 21 | 3837 |
| 1207006 | 2018 | 2033 | 7406 | 7421 | $C_{ks}A_{es}C_{ks}T_{ds}T_{ds}T_{ds}A_{ds}T_{ds}T_{ds}G_{ds}A_{ds}G_{ds}T_{es}T_{es}{}^mC_{ks}{}^mC_k$ | 20 | 2924 |
| 1207014 | 2033 | 2048 | 7421 | 7436 | $T_{ks}{}^mC_{es}A_{ks}G_{ds}{}^mC_{ds}A_{ds}T_{ds}T_{ds}T_{ds}{}^mC_{ds}A_{ds}A_{es}A_{es}G_{ks}C_k$ | 44 | 3534 |
| 1207033 | 148 | 163 | 515 | 530 | $G_{ks}A_{ks}C_{ds}T_{ds}G_{ds}T_{ds}G_{ds}T_{ds}G_{ds}C_{ds}T_{ds}C_{es}T_{es}T_{es}C_{ks}A_k$ | 11 | 3343 |
| 1207041 | 156 | 171 | N/A | N/A | $G_{ks}T_{ks}G_{ds}A_{ds}G_{ds}A_{ds}A_{ds}{}^mC_{ds}G_{ds}A_{ds}{}^mC_{ds}T_{es}G_{es}T_{es}G_{ks}T_k$ | 48 | 2424 |
| 1207049 | 213 | 228 | 3564 | 3579 | $T_{ks}T_{ks}G_{ds}T_{ds}G_{ds}G_{ds}T_{ds}A_{ds}{}^mC_{ds}A_{ds}G_{ds}{}^mC_{es}T_{es}G_{es}{}^mC_{ks}{}^mC_k$ | 25 | 2811 |
| 1207057 | 221 | 236 | 3572 | 3587 | $G_{ks}G_{ks}G_{ds}T_{ds}A_{ds}{}^mC_{ds}A_{ds}T_{ds}T_{ds}T_{ds}G_{ds}T_{es}G_{es}G_{es}T_{ks}A_k$ | 47 | 3345 |

TABLE 79-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207071 | 1781 | 1796 | 7169 | 7184 | $T_{ks}G_{ks}{}^mC_{ds}{}^mC_{ds}T_{ds}T_{ds}G_{ds}{}^mC_{ds}A_{ds}G_{ds}G_{ds}G_{es}T_{es}G_{es}A_{ks}G_k$ | 35 | 3527 |
| 1207086 | 1789 | 1804 | 7177 | 7192 | $G_{ks}{}^mC_{ks}T_{ds}G_{ds}A_{ds}T_{ds}G_{ds}A_{ds}T_{ds}G_{ds}{}^mC_{ds}C_{es}T_{es}T_{es}G_{ks}C_k$ | 24 | 3755 |
| 1207094 | 1895 | 1910 | 7283 | 7298 | $A_{ks}G_{ks}T_{ds}{}^mC_{ds}{}^mC_{ds}{}^mC_{ds}T_{ds}G_{ds}A_{ds}G_{ds}{}^mC_{ds}A_{es}A_{es}T_{es}T_{ks}A_k$ | 36 | 3758 |
| 1207102 | 1903 | 1918 | 7291 | 7306 | $G_{ks}A_{ks}A_{ds}A_{ds}G_{ds}A_{ds}T_{ds}G_{ds}G_{ds}A_{ds}G_{ds}T_{ds}C_{es}{}^mC_{es}{}^mC_{es}T_{ks}G_k$ | 28 | 2845 |
| 1207110 | 1918 | 1933 | 7306 | 7321 | $G_{ks}A_{ks}A_{ds}T_{ds}C_{ds}A_{ds}C_{ds}C_{ds}A_{ds}A_{ds}G_{ds}G_{es}A_{es}G_{ks}G_k$ | 24 | 4965 |
| 1207118 | 1926 | 1941 | 7314 | 7329 | $T_{ks}{}^mC_{ks}A_{ds}{}^mC_{ds}T_{ds}G_{ds}{}^mC_{ds}G_{ds}G_{ds}A_{ds}A_{ds}T_{es}{}^mC_{es}A_{es}{}^mC_{ks}{}^mC_k$ | 12 | 3759 |
| 1207135 | 1934 | 1949 | 7322 | 7337 | ${}^mC_{ks}{}^m{}_{ks}A_{ds}C_{ds}A_{ds}C_{ds}A_{ds}C_{ds}A_{ds}A_{ds}{}^mC_{es}T_{es}G_{es}{}^mC_{ks}G_k$ | 16 | 4949 |
| 1207155 | 2012 | 2027 | 7400 | 7415 | ${}^mC_{ks}{}^mC_{ks}A_{ds}{}^mC_{ds}T_{ds}G_{ds}{}^mC_{ds}A_{ds}T_{ds}C_{ds}C_{es}T_{es}G_{es}{}^mC_{ks}C_k$ | 33 | 2540 |
| 1207163 | 2021 | 2036 | 7409 | 7424 | $A_{ks}T_{ks}T_{ds}G_{ds}A_{ds}G_{ds}T_{ds}T_{ds}C_{ds}{}^mC_{ds}T_{ds}G_{es}{}^mC_{es}G_{es}{}^mC_{ks}{}^mC_k$ | 22 | 3147 |
| 1207171 | 143 | 158 | 510 | 525 | $A_{ks}A_{ks}G_{ds}C_{ds}A_{ds}C_{ds}T_{ds}T_{ds}T_{ds}A_{ds}T_{ds}T_{es}G_{es}A_{es}G_{ks}T_k$ | 49 | 3037 |
| 1207179 | 151 | 166 | N/A | N/A | $T_{ks}G_{ks}T_{ds}G_{ds}{}^mC_{ds}T_{ds}{}^mC_{ds}T_{ds}T_{ds}{}^mC_{ds}A_{ds}G_{es}{}^mC_{ks}T_{es}T_{ks}T_e$ | 43 | 3571 |
| 1207187 | 208 | 223 | 3559 | 3574 | $A_{ks}A_{ks}C_{ds}G_{ds}A_{ds}C_{ds}T_{ds}G_{ds}T_{ds}G_{ds}T_{ds}G_{es}{}^mC_{ks}T_{es}{}^mC_{ks}T_e$ | 45 | 4968 |
| 1207195 | 216 | 231 | 3567 | 3582 | $G_{ks}T_{ks}A_{ds}{}^mC_{ds}A_{ds}G_{ds}{}^mC_{ds}T_{ds}G_{ds}{}^mC_{ds}{}^mC_{ds}G_{es}G_{ks}T_{es}G_{ks}G_e$ | 26 | 3039 |
| 1207203 | 1776 | 1791 | 7164 | 7179 | ${}^mC_{ks}A_{ks}T_{ds}T_{ds}T_{ds}G_{ds}T_{ds}G_{ds}G_{ds}T_{ds}A_{ds}C_{es}A_{ks}G_{es}C_{ks}T_e$ | 68 | 3299 |
| 1207211 | 1784 | 1799 | 7172 | 7187 | $T_{ks}G_{ks}C_{ds}A_{ds}G_{ds}G_{ds}G_{ds}G_{ds}T_{ds}G_{ds}A_{ds}G_{ds}{}^mC_{es}{}^mC_{ks}G_{es}G_{ks}{}^mC_e$ | 46 | 4969 |
| 1207219 | 1792 | 1807 | 7180 | 7195 | $T_{ks}G_{ks}A_{ds}T_{ds}G_{ds}{}^mC_{ds}{}^mC_{ds}T_{ds}T_{ds}G_{ds}{}^mC_{ds}A_{es}G_{ks}G_{es}G_{ks}T_e$ | 39 | 4970 |
| 1207227 | 1898 | 1913 | 7286 | 7301 | ${}^mC_{ks}{}^mC_{ks}A_{ds}G_{ds}{}^mC_{ds}T_{ds}G_{ds}G_{ds}A_{ds}T_{ds}G_{ds}A_{ds}T_{es}G_{ks}{}^mC_{es}{}^mC_{ks}T_e$ | 31 | 2460 |
| 1207235 | 1906 | 1921 | 7294 | 7309 | $A_{ks}T_{ks}G_{ds}A_{ds}G_{ds}T_{ds}C_{ds}C_{ds}C_{ds}T_{ds}G_{ds}A_{es}G_{es}{}^mC_{es}A_{ks}A_e$ | 46 | 3073 |
| 1207243 | 1921 | 1936 | 7309 | 7324 | $A_{ks}G_{ks}G_{ds}G_{ds}A_{ds}A_{ds}A_{ds}G_{ds}A_{ds}T_{ds}G_{ds}A_{es}G_{ks}T_{es}{}^mC_{ks}{}^mC_e$ | 26 | 3379 |
| 1207251 | 1929 | 1944 | 7317 | 7332 | $G_{ks}{}^mC_{ks}G_{ds}G_{ds}A_{ds}A_{ds}T_{ds}{}^mC_{ds}A_{ds}{}^mC_{ds}C_{ds}A_{es}A_{ks}G_{es}G_{ks}A_e$ | 11 | 4971 |
| 1207259 | 1937 | 1952 | 7325 | 7340 | ${}^mC_{ks}T_{ks}{}^mC_{ds}T_{ds}{}^mC_{ds}A_{ds}A_{ds}{}^mC_{ds}T_{ds}G_{ds}{}^mC_{ds}G_{ds}G_{es}A_{ks}A_{es}T_{ks}{}^mC_e$ | 20 | 4972 |
| 1207267 | 2007 | 2022 | 7395 | 7410 | ${}^mC_{ks}A_{ks}G_{ds}{}^mC_{ds}{}^mC_{ds}A_{ds}{}^mC_{ds}T_{ds}{}^mC_{ds}T_{ds}C_{ds}T_{es}{}^mC_{ks}A_{es}{}^mC_{ks}T_e$ | 32 | 3685 |
| 1207275 | 2016 | 2031 | 7404 | 7419 | $G_{ks}T_{ks}T_{ds}{}^mC_{ds}{}^mC_{ds}T_{ds}G_{ds}{}^mC_{ds}G_{ds}{}^mC_{ds}{}^mC_{ds}A_{es}T_{ks}{}^mC_{es}{}^mC_{ks}T_e$ | 10 | 2771 |

TABLE 79-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207283 | 2024 | 2039 | 7412 | 7427 | $C_{ks}T_{ks}T_{ds}T_{ds}A_{ds}T_{ds}T_{ds}G_{ds}A_{ds}G_{ds}T_{ds}T_{es}{}^mC_{ks}{}^mC_{es}T_{ks}G_e$ | 24 | 3382 |
| 1207291 | 146 | 161 | 513 | 528 | $T_{ks}{}^mC_{ks}A_{ds}A_{ds}A_{ds}G_{ds}{}^mC_{ds}A_{ds}{}^mC_{ds}T_{ds}T_{ds}T_{es}A_{ks}T_{es}T_{ks}G_e$ | 29 | 3190 |
| 1207299 | 154 | 169 | N/A | N/A | ${}^mC_{ks}T_{ks}G_{ds}T_{ds}G_{ds}T_{ds}G_{ds}{}^mC_{ds}T_{ds}{}^mC_{ds}T_{ds}T_{ks}{}^mC_{es}A_{ks}G_{es}{}^mC_k$ | 56 | 3799 |
| 1207307 | 211 | 226 | 3562 | 3577 | $G_{ks}A_{ks}G_{ds}A_{ds}A_{ds}{}^mC_{ds}G_{ds}A_{ds}{}^mC_{ds}T_{ds}G_{ds}T_{ks}G_{es}T_{ks}G_{es}{}^{mm}C_k$ | 36 | 4973 |
| 1207315 | 219 | 234 | 3570 | 3585 | $G_{ks}T_{ks}G_{ds}G_{ds}T_{ds}A_{ds}{}^mC_{ds}A_{ds}G_{ds}{}^mC_{ds}T_{ds}G_{ks}C_{es}C_{ks}G_{es}G_k$ | 88 | 3192 |
| 1207323 | 1779 | 1794 | 7167 | 7182 | $G_{ks}T_{ks}A_{ds}{}^mC_{ds}A_{ds}T_{ds}T_{ds}T_{ds}G_{ds}T_{ds}G_{ds}G_{ks}T_{es}A_{ks}{}^mC_{es}A_k$ | 41 | 4974 |
| 1207331 | 1787 | 1802 | 7175 | 7190 | ${}^mC_{ks}{}^mC_{ks}T_{ds}T_{ds}G_{ds}{}^mC_{ds}A_{ds}G_{ds}G_{ds}G_{ds}T_{ds}G_{ks}A_{es}G_{ks}{}^mC_{es}{}^mC_k$ | 35 | 4975 |
| 1207339 | 1893 | 1908 | 7281 | 7296 | $T_{ks}{}^mC_{ks}{}^mC_{ds}{}^mC_{ds}T_{ds}G_{ds}A_{ds}A_{ds}G_{ds}{}^mC_{ds}A_{ds}A_{ds}T_{ks}{}^mC_{es}A_{ks}G_{es}G_k$ | 44 | 3606 |
| 1207347 | 1901 | 1916 | 7289 | 7304 | $A_{ks}A_{ks}G_{ds}A_{ds}T_{ds}G_{ds}A_{ds}A_{ds}G_{ds}T_{ds}{}^mC_{ds}{}^mC_{ds}{}^mC_{ks}T_{es}G_{ks}A_{es}G_k$ | 37 | 2691 |
| 1207355 | 1916 | 1931 | 7304 | 7319 | $A_{ks}T_{ks}{}^mC_{ds}A_{ds}{}^mC_{ds}{}^mC_{ds}A_{ds}A_{ds}G_{ds}G_{ds}A_{ds}G_{ks}G_{es}G_{ks}A_{es}A_k$ | 41 | 4966 |
| 1207363 | 1924 | 1939 | 7312 | 7327 | $A_{ks}{}^mC_{ks}T_{ds}G_{ds}{}^mC_{ds}G_{ds}G_{ds}G_{ds}A_{ds}A_{ds}T_{ds}{}^mC_{ds}A_{ks}{}^mC_{es}{}^mC_{ks}A_{es}A_k$ | 22 | 3607 |
| 1207371 | 1932 | 1947 | 7320 | 7335 | $A_{ks}{}^mC_{ks}T_{ds}{}^mC_{ds}T_{ds}{}^mC_{ds}T_{ds}{}^mC_{ds}A_{ds}{}^mC_{ds}T_{ds}G_{ks}{}^mC_{es}G_{ks}G_{es}A_k$ | 22 | 4976 |
| 1207379 | 2002 | 2017 | 7390 | 7405 | $T_{ks}G_{ks}{}^mC_{ds}G_{ds}{}^mC_{ds}{}^mC_{ds}A_{ds}A_{ds}A_{ds}{}^mC_{ds}C_{ds}T_{ds}G_{ks}G_{es}{}^mC_{ks}G_{es}{}^mC_k$ | 96 | 3305 |
| 1207387 | 2010 | 2025 | 7398 | 7413 | $T_{ks}G_{ks}A_{ds}G_{ds}T_{ds}T_{ds}{}^mC_{ds}{}^mC_{ds}T_{ds}G_{ds}{}^mC_{ds}G_{ks}T_{es}T_{ks}A_{es}T_k$ | 24 | 3913 |
| 1207395 | 2019 | 2034 | 7407 | 7422 | $G_{ks}{}^mC_{ks}A_{ds}{}^mC_{ds}T_{ds}T_{ds}T_{ds}A_{ds}T_{ds}G_{ds}A_{ks}G_{es}T_{ks}T_{es}{}^mC_k$ | 26 | 3000 |
| 1207403 | 141 | 156 | 508 | 523 | $T_{ks}G_{ks}C_{ks}T_{ds}{}^mC_{ds}T_{ds}T_{ds}{}^mC_{ds}A_{ds}G_{ds}{}^mC_{ds}T_{ds}T_{ks}T_{ks}G_{ks}T_e$ | 38 | 4950 |
| 1207411 | 149 | 164 | 516 | 531 | ${}^mC_{ks}G_{ks}A_{ks}{}^mC_{ds}T_{ds}G_{ds}T_{ds}G_{ds}T_{ds}G_{ds}{}^mC_{ds}T_{ds}{}^mC_{ks}T_{ks}T_{ks}{}^mC_e$ | 24 | 3419 |
| 1207419 | 157 | 172 | N/A | N/A | $A_{ks}G_{ks}T_{ks}G_{ds}A_{ds}G_{ds}A_{ds}A_{ds}A_{ds}{}^mC_{ds}G_{ds}A_{ds}{}^mC_{ds}T_{ks}G_{ks}T_{ks}G_e$ | 25 | 2502 |
| 1207427 | 214 | 229 | 3565 | 3580 | $T_{ks}T_{ks}T_{ks}G_{ds}T_{ds}G_{ds}G_{ds}T_{ds}A_{ds}{}^mC_{ds}A_{ds}G_{ds}T_{ks}T_{ks}GTC_e$ | 31 | 2887 |
| 1207435 | 222 | 237 | 3573 | 3588 | $T_{ks}G_{ks}G_{ks}G_{ds}T_{ds}G_{ds}{}^mC_{ds}A_{ds}T_{ds}T_{ds}T_{ds}G_{ds}T_{ks}G_{ks}G_{ks}T_e$ | 53 | 3421 |
| 1207443 | 1782 | 1797 | 7170 | 7185 | $A_{ks}T_{ks}G_{ks}{}^mC_{ds}{}^mC_{ds}T_{ds}T_{ds}G_{ds}{}^mC_{ds}A_{ds}G_{ds}G_{ds}G_{ks}T_{ks}G_{ks}A_e$ | 46 | 4947 |
| 1207451 | 1790 | 1805 | 7178 | 7193 | $A_{ks}G_{ks}{}^mC_{ks}T_{ds}G_{ds}A_{ds}T_{ds}G_{ds}A_{ds}A_{ds}T_{ds}G_{ds}{}^mC_{ds}T_{ks}T_{ks}T_{ks}G_e$ | 49 | 3831 |
| 1207459 | 1896 | 1911 | 7284 | 7299 | $G_{ks}A_{ks}G_{ks}T_{ds}{}^mC_{ds}{}^mC_{ds}{}^mC_{ds}T_{ds}G_{ds}A_{ds}G_{ds}{}^mC_{ds}A_{ks}A_{ks}T_{ks}{}^mC_e$ | 33 | 3834 |

TABLE 79-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207467 | 1904 | 1919 | 7292 | 7307 | $G_{ks}G_{ks}A_{ks}A_{ds}A_{ds}G_{ds}A_{ds}T_{ds}G_{ds}A_{ds}G_{ds}T_{ds}{}^mC_{ks}{}^mC_{ks}{}^mC_{ks}T_e$ | 38 | 2921 |
| 1207475 | 1919 | 1934 | 7307 | 7322 | $G_{ks}G_{ks}A_{ks}A_{ds}T_{ds}{}^mC_{ds}A_{ds}{}^mC_{ds}{}^mC_{ds}A_{ds}A_{ds}G_{ds}G_{ks}A_{ks}G_{ks}G_e$ | 16 | 3226 |
| 1207483 | 1927 | 1942 | 7315 | 7330 | ${}^mC_{ks}T_{ks}{}^mC_{ks}A_{ds}{}^mC_{ds}T_{ds}G_{ds}{}^mC_{ds}G_{ds}G_{ds}A_{ds}A_{ds}T_{ks}{}^mC_{ks}A_{ks}{}^mC_e$ | 22 | 3835 |
| 1207491 | 1935 | 1950 | 7323 | 7338 | $G_{ks}{}^mC_{ks}{}^mC_{ks}A_{ds}{}^mC_{ds}T_{ds}{}^mC_{ds}T_{ds}{}^mC_{ds}T_{ds}{}^mC_{ds}A_{ds}{}^mC_{ks}T_{ks}G_{ks}{}^mC_e$ | 22 | 4967 |
| 1207499 | 2005 | 2020 | 7393 | 7408 | $T_{ks}{}^mC_{ks}{}^mC_{ks}T_{ds}G_{ds}{}^mC_{ds}G_{ds}{}^mC_{ds}{}^mC_{ds}A_{ds}T_{ds}{}^mC_{ds}{}^mC_{ks}T_{ks}G_{ks}G_e$ | 21 | 3533 |
| 1207507 | 2013 | 2028 | 7401 | 7416 | $T_{ks}A_{ks}T_{ks}T_{ds}G_{ds}A_{ds}G_{ds}T_{ds}T_{ds}{}^mC_{ds}{}^mC_{ds}T_{ds}G_{ks}{}^mC_{ks}G_{ks}{}^mC_e$ | 26 | 2617 |
| 1207515 | 2022 | 2037 | 7410 | 7425 | $A_{ks}A_{ks}A_{ks}G_{ds}{}^mC_{ds}A_{ds}{}^mC_{ds}T_{ds}T_{ds}T_{ds}A_{ds}T_{ds}T_{ks}G_{ks}A_{ks}G_e$ | 21 | 3229 |

TABLE 80

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1129531 | 2009 | 2024 | 7397 | 7412 | $G_{ks}A_{ks}G_{ks}T_{ds}T_{ds}{}^mC_{ds}{}^mC_{ds}T_{ds}G_{ds}{}^mC_{ds}G_{ds}{}^mC_{ds}{}^mC_{ds}A_{ks}T_{ks}{}^mC_k$ | 19 | 3837 |
| 1206476 | 144 | 159 | 511 | 526 | $G_{ks}T_{ks}G_{ks}T_{ds}G_{ds}{}^mC_{ds}T_{ds}{}^mC_{ds}T_{ds}T_{ds}{}^mC_{ds}A_{ds}G_{ds}C_{ks}T_{ks}T_k$ | 24 | 4951 |
| 1206481 | 1784 | 1799 | 7172 | 7187 | $T_{ks}G_{ks}A_{ks}T_{ds}G_{ds}C_{ds}C_{ds}T_{ds}T_{ds}G_{ds}C_{ds}A_{ds}G_{ds}G_{ks}G_{ks}T_k$ | 42 | 4969 |
| 1206505 | 1917 | 1932 | 7305 | 7320 | $A_{ks}A_{ks}T_{ks}{}^mC_{ds}A_{ds}{}^mC_{ds}{}^mC_{ds}A_{ds}A_{ds}G_{ds}G_{ds}A_{ds}G_{ds}G_{ks}G_{ks}A_k$ | 27 | 4956 |
| 1206508 | 1936 | 1951 | 7324 | 7339 | $A_{ks}G_{ks}{}^mC_{ks}{}^mC_{ds}A_{ds}{}^mC_{ds}T_{ds}{}^mC_{ds}T_{ds}{}^mC_{ds}T_{ds}{}^mC_{ds}A_{ds}{}^mC_{ks}T_{ks}G_k$ | 9 | 4961 |
| 1206903 | 146 | 161 | 513 | 528 | ${}^mC_{ks}T_{es}G_{ks}T_{ds}G_{ds}{}^mC_{ds}T_{ds}{}^mC_{ds}T_{ds}T_{ds}{}^mC_{ds}T_{es}A_{es}G_{ks}{}^mC_k$ | 14 | 3190 |
| 1206911 | 154 | 169 | N/A | N/A | $G_{ks}A_{es}G_{ks}A_{ds}A_{ds}{}^mC_{ds}G_{ds}G_{ds}A_{ds}{}^mC_{ds}T_{ds}G_{ds}T_{ds}G_{es}T_{es}G_{ks}{}^mC_k$ | 29 | 3799 |
| 1206919 | 211 | 226 | 3562 | 3577 | $G_{ks}T_{es}G_{ks}G_{ds}T_{ds}A_{ds}{}^mC_{ds}A_{ds}G_{ds}{}^mC_{ds}T_{ds}G_{ds}C_{es}C_{es}G_{ks}G_k$ | 24 | 4973 |
| 1206927 | 219 | 234 | 3570 | 3585 | $G_{ks}T_{es}A_{ks}{}^mC_{ds}A_{ds}T_{ds}T_{ds}T_{ds}G_{ds}T_{ds}G_{ds}G_{ds}T_{es}A_{es}{}^mC_{ks}A_k$ | 27 | 3192 |
| 1206935 | 1779 | 1794 | 7167 | 7182 | ${}^mC_{ks}{}^mC_{es}T_{ks}T_{ds}G_{ds}{}^mC_{ds}A_{ds}G_{ds}G_{ds}G_{ds}T_{ds}G_{ds}A_{es}G_{es}{}^mC_{ks}{}^mC_k$ | 51 | 4974 |
| 1206943 | 1787 | 1802 | 7175 | 7190 | $T_{ks}G_{es}A_{ks}T_{ds}G_{ds}A_{ds}T_{ds}G_{ds}{}^mC_{ds}{}^mC_{ds}T_{ds}T_{ds}G_{es}C_{es}A_{ks}G_k$ | 36 | 4975 |

TABLE 80-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1206951 | 1893 | 1908 | 7281 | 7296 | $T_{ks}C_{es}{}^mC_{ks}C_{ds}T_{ds}G_{ds}A_{ds}A_{ds}G_{ds}C_{ds}A_{ds}A_{ds}T_{ds}{}^mC_{es}A_{es}G_{ks}G_k$ | 46 | 3606 |
| 1206959 | 1901 | 1916 | 7289 | 7304 | $A_{ks}A_{es}G_{ks}A_{ds}T_{ds}G_{ds}A_{ds}G_{ds}T_{ds}{}^mC_{ds}{}^mC_{ds}{}^mC_{ds}T_{es}G_{es}A_{ks}G_k$ | 34 | 2691 |
| 1206967 | 1916 | 1931 | 7304 | 7319 | $A_{ks}T_{es}{}^mC_{ks}A_{ds}{}^mC_{ds}{}^mC_{ds}A_{ds}A_{ds}G_{ds}G_{ds}A_{ds}G_{ds}G_{es}G_{es}A_{ks}A_k$ | 14 | 4966 |
| 1206975 | 1924 | 1939 | 7312 | 7327 | $A_{ks}{}^mC_{es}T_{ks}G_{ds}{}^mC_{ds}G_{ds}G_{ds}A_{ds}A_{ds}T_{ds}{}^mC_{ds}A_{ds}{}^mC_{es}{}^mC_{es}A_{ks}A_k$ | 13 | 3607 |
| 1206983 | 1932 | 1947 | 7320 | 7335 | $A_{ks}{}^mC_{es}T_{ks}{}^mC_{ds}T_{ds}{}^mC_{ds}T_{ds}{}^mC_{ds}A_{ds}C_{ds}T_{ds}G_{ds}C_{es}G_{es}G_{ks}A_k$ | 9 | 4976 |
| 1206991 | 2002 | 2017 | 7390 | 7405 | $T_{ks}G_{es}{}^mC_{ks}G_{ds}{}^mC_{ds}{}^mC_{ds}A_{ds}T_{ds}{}^mC_{ds}{}^mC_{ds}T_{ds}G_{ds}G_{es}C_{es}G_{ks}C_k$ | 64 | 3305 |
| 1206999 | 2010 | 2025 | 7398 | 7413 | $T_{ks}G_{es}A_{ks}G_{ds}T_{ds}{}^mC_{ds}{}^mC_{ds}T_{ds}G_{ds}{}^mC_{ds}G_{ds}{}^mC_{es}{}^mC_{es}A_{ks}T_k$ | 12 | 3913 |
| 1207007 | 2019 | 2034 | 7407 | 7422 | $G_{ks}{}^mC_{es}A_{ks}{}^mC_{ds}T_{ds}T_{ds}T_{ds}A_{ds}T_{ds}T_{ds}G_{ds}A_{ds}G_{es}T_{ks}{}^mC_k$ | 7 | 3000 |
| 1207026 | 141 | 156 | 508 | 523 | $T_{ks}G_{ks}C_{ds}T_{ds}C_{ds}T_{ds}T_{ds}C_{ds}A_{ds}G_{ds}C_{ds}T_{es}T_{es}T_{es}G_{ks}T_k$ | 49 | 4950 |
| 1207034 | 149 | 164 | 516 | 531 | ${}^mC_{ks}G_{ks}A_{ds}{}^mC_{ds}T_{ds}G_{ds}T_{ds}G_{ds}T_{ds}G_{ds}{}^mC_{ds}T_{es}{}^mC_{es}T_{ks}{}^mC_k$ | 36 | 3419 |
| 1207042 | 157 | 172 | N/A | N/A | $A_{ks}G_{ks}T_{ds}G_{ds}A_{ds}G_{ds}A_{ds}A_{ds}{}^mC_{ds}G_{ds}A_{ds}{}^mC_{es}T_{es}G_{es}T_{ks}G_k$ | 42 | 2502 |
| 1207050 | 214 | 229 | 3565 | 3580 | $T_{ks}T_{ks}T_{ds}G_{ds}T_{ds}G_{ds}G_{ds}T_{ds}A_{ds}{}^mC_{ds}A_{ds}G_{es}{}^mC_{es}T_{es}G_{ks}{}^mC_k$ | 43 | 2887 |
| 1207058 | 222 | 237 | 3573 | 3588 | $T_{ks}G_{ks}G_{ds}G_{ds}T_{ds}A_{ds}A_{ds}{}^mC_{ds}A_{ds}T_{ds}T_{ds}T_{ds}G_{es}T_{es}G_{es}G_{ks}T_k$ | 25 | 3421 |
| 1207078 | 1782 | 1797 | 7170 | 7185 | $A_{ks}T_{ks}G_{ds}{}^mC_{ds}{}^mC_{ds}T_{ds}T_{ds}G_{ds}{}^mC_{ds}A_{ds}G_{ds}G_{es}G_{es}T_{es}G_{ks}A_k$ | 52 | 4947 |
| 1207087 | 1790 | 1805 | 7178 | 7193 | $A_{ks}G_{ks}C_{ds}T_{ds}G_{ds}A_{ds}T_{ds}G_{ds}A_{ds}T_{ds}G_{ds}{}^mC_{es}{}^mC_{es}$ | 42 | 3831 |
| 1207095 | 1896 | 1911 | 7284 | 7299 | $G_{ks}A_{ks}G_{ds}T_{ds}{}^mC_{ds}{}^mC_{ds}{}^mC_{ds}T_{ds}G_{ds}A_{ds}G_{ds}{}^mC_{es}A_{es}A_{es}T_{ks}{}^mC_k$ | 25 | 3834 |
| 1207103 | 1904 | 1919 | 7292 | 7307 | $G_{ks}G_{ks}A_{ds}A_{ds}A_{ds}G_{ds}A_{ds}T_{ds}G_{ds}A_{ds}G_{ds}T_{es}{}^mC_{es}{}^mC_{es}{}^mC_{ks}T_k$ | 31 | 2921 |
| 1207111 | 1919 | 1934 | 7307 | 7322 | $G_{ks}G_{ks}A_{ds}A_{ds}T_{ds}C_{ds}C_{ds}C_{ds}A_{ds}A_{ds}G_{es}G_{es}A_{es}G_{ks}G_k$ | 9 | 3226 |
| 1207120 | 1927 | 1942 | 7315 | 7330 | ${}^mC_{ks}T_{ks}{}^mC_{ds}A_{ds}{}^mC_{ds}T_{ds}G_{ds}{}^mC_{ds}G_{ds}G_{ds}A_{ds}A_{es}T_{es}C_{es}A_{ks}C_k$ | 10 | 3835 |
| 1207137 | 1935 | 1950 | 7323 | 7338 | $G_{ks}{}^mC_{ks}{}^mC_{ds}A_{ds}{}^mC_{ds}T_{ds}{}^mC_{ds}T_{ds}{}^mC_{ds}T_{ds}{}^mC_{ds}T_{ds}C_{ds}A_{es}C_{es}T_{es}G_{ks}C_k$ | 19 | 4967 |
| 1207148 | 2005 | 2020 | 7393 | 7408 | $T_{ks}{}^mC_{ks}{}^mC_{ds}T_{ds}G_{ds}{}^mC_{ds}G_{ds}{}^mC_{ds}{}^mC_{ds}A_{ds}T_{ds}{}^mC_{es}{}^mC_{es}T_{es}G_{ks}G_k$ | 13 | 3533 |
| 1207156 | 2013 | 2028 | 7401 | 7416 | $T_{ks}A_{ks}T_{ds}G_{ds}A_{ds}G_{ds}T_{ds}T_{ds}{}^mC_{ds}{}^mC_{ds}T_{es}G_{es}{}^mC_{es}G_{ks}{}^mC_k$ | 9 | 2617 |
| 1207164 | 2022 | 2037 | 7410 | 7425 | $A_{ks}A_{ks}A_{ds}G_{ds}C_{ds}A_{ds}C_{ds}T_{ds}T_{ds}T_{ds}A_{ds}T_{es}T_{es}G_{es}A_{ks}G_k$ | 5 | 3229 |

TABLE 80-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207172 | 144 | 159 | 511 | 526 | $G_{ks}T_{ks}G_{ds}T_{ds}G_{ds}{}^mC_{ds}T_{ds}{}^mC_{ds}T_{ds}T_{ds}{}^mC_{ds}A_{es}G_{ks}{}^mC_{es}T_{ks}T_e$ | 14 | 4951 |
| 1207180 | 152 | 167 | N/A | N/A | $G_{ks}A_{ks}A_{ds}{}^mC_{ds}G_{ds}A_{ds}{}^mC_{ds}T_{ds}G_{ds}G_{ds}T_{es}G_{ks}{}^mC_{es}T_{ks}{}^mC_e$ | 32 | 3647 |
| 1207188 | 209 | 224 | 3560 | 3575 | $G_{ks}G_{ks}T_{ds}A_{ds}{}^mC_{ds}A_{ds}G_{ds}{}^mC_{ds}T_{ds}G_{ds}{}^mC_{ds}{}^mC_{es}G_{ks}G_{es}T_{ks}G_e$ | 23 | 4952 |
| 1207196 | 217 | 232 | 3568 | 3583 | $A_{ks}C_{ks}A_{ds}T_{ds}T_{ds}T_{ds}G_{ds}T_{ds}G_{ds}G_{ds}T_{ds}A_{es}{}^mC_{ks}A_{es}G_{ks}{}^mC_e$ | 13 | 3114 |
| 1207204 | 1777 | 1792 | 7165 | 7180 | $T_{ks}T_{ks}G_{ds}{}^mC_{ds}A_{ds}G_{ds}G_{ds}G_{ds}T_{ds}G_{ds}A_{ds}G_{es}C_{ks}C_{es}G_{ks}G_e$ | 50 | 3375 |
| 1207212 | 1785 | 1800 | 7173 | 7188 | $A_{ks}T_{ks}G_{ds}A_{ds}T_{ds}G_{ds}G_{ds}C_{ds}C_{ds}T_{ds}T_{ds}G_{ds}C_{es}A_{ks}G_{es}G_{ks}G_e$ | 25 | 3603 |
| 1207220 | 1793 | 1808 | 7181 | 7196 | $C_{ks}C_{ks}C_{ds}A_{ds}G_{ds}{}^mC_{ds}T_{ds}G_{ds}A_{ds}T_{ds}G_{ds}A_{es}T_{ks}G_{es}{}^mC_{ks}{}^mC_e$ | 26 | 4953 |
| 1207228 | 1899 | 1914 | 7287 | 7302 | $G_{ks}A_{ks}T_{ds}G_{ds}A_{ds}G_{ds}T_{ds}{}^mC_{ds}{}^mC_{ds}{}^mC_{ds}T_{ds}G_{es}A_{ks}G_{es}{}^mC_{ks}A_e$ | 6 | 2537 |
| 1207236 | 1914 | 1929 | 7302 | 7317 | ${}^mC_{ks}A_{ks}{}^mC_{ds}{}^mC_{ds}A_{ds}A_{ds}A_{ds}G_{ds}G_{ds}A_{ds}G_{ds}G_{es}A_{ks}A_{es}A_{ks}G_e$ | 12 | 4954 |
| 1207244 | 1922 | 1937 | 7310 | 7325 | $T_{ks}G_{ks}{}^mC_{ds}G_{ds}G_{ds}A_{ds}A_{ds}T_{ds}{}^mC_{ds}A_{ds}{}^mC_{ds}{}^mC_{es}A_{ks}A_{es}G_{ks}G_e$ | 17 | 3455 |
| 1207252 | 1930 | 1945 | 7318 | 7333 | $T_{ks}{}^mC_{ks}T_{ds}{}^mC_{ds}T_{ds}{}^mC_{ds}A_{ds}{}^mC_{ds}T_{ds}G_{ds}{}^mC_{ds}G_{es}{}^mC_{ks}A_{es}A_{ks}T_e$ | 16 | 4955 |
| 1207260 | 2000 | 2015 | 7388 | 7403 | ${}^mC_{ks}G_{ks}{}^mC_{ds}{}^mC_{ds}A_{ds}T_{ds}{}^mC_{ds}{}^mC_{ds}T_{ds}G_{ds}G_{ds}{}^mC_{es}G_{ks}{}^mC_{es}G_{ks}G_e$ | 77 | 3228 |
| 1207268 | 2008 | 2023 | 7396 | 7411 | $A_{ks}G_{ks}T_{ds}T_{ds}{}^mC_{ds}{}^mC_{ds}T_{ds}G_{ds}{}^mC_{ds}G_{ds}{}^mC_{ds}{}^mC_{es}A_{ks}T_{es}{}^mC_{ks}{}^mC_e$ | 18 | 3761 |
| 1207276 | 2017 | 2032 | 7405 | 7420 | $A_{ks}C_{ks}T_{ds}T_{ds}T_{ds}A_{ds}T_{ds}G_{ds}G_{ds}A_{ds}G_{ds}T_{es}T_{ks}{}^mC_{es}{}^mC_{ks}T_e$ | 8 | 2848 |
| 1207284 | 2031 | 2046 | 7419 | 7434 | $A_{ks}G_{ks}{}^mC_{ds}A_{ds}T_{ds}T_{ds}T_{ds}T_{ds}{}^mC_{ds}A_{ds}A_{ds}A_{es}G_{ks}{}^mC_{es}A_{ks}{}^mC_e$ | 20 | 3458 |
| 1207292 | 147 | 162 | 514 | 529 | $A_{ks}{}^mC_{ks}T_{ds}G_{ds}T_{ds}G_{ds}T_{ds}G_{ds}{}^mC_{ds}T_{ds}{}^mC_{ds}T_{ks}T_{es}{}^mC_{ks}A_{es}G_k$ | 36 | 3267 |
| 1207300 | 155 | 170 | N/A | N/A | $T_{ks}G_{ks}A_{ds}G_{ds}A_{ds}A_{ds}{}^mC_{ds}G_{ds}A_{ds}{}^mC_{ds}T_{ds}G_{es}T_{ks}G_{es}T_{es}G_k$ | 25 | 3875 |
| 1207308 | 212 | 227 | 3563 | 3578 | $T_{ks}G_{ks}T_{ds}G_{ds}G_{ds}T_{ds}A_{ds}C_{ds}A_{ds}G_{ds}C_{ds}T_{ks}G_{es}{}^mC_{ks}{}^mC_{es}G_k$ | 18 | 2734 |
| 1207316 | 220 | 235 | 3571 | 3586 | $G_{ks}G_{ks}T_{ds}A_{ds}C_{ds}A_{ds}T_{ds}T_{ds}T_{ds}G_{ds}T_{ds}G_{ks}G_{es}T_{ks}A_{es}{}^mC_k$ | 49 | 3269 |
| 1207324 | 1780 | 1795 | 7168 | 7183 | $G_{ks}{}^mC_{ks}{}^mC_{ds}T_{ds}T_{ds}G_{ds}{}^mC_{ds}A_{ds}G_{ds}G_{ds}G_{ds}T_{ks}G_{es}A_{ks}G_{es}{}^mC_k$ | 47 | 3451 |
| 1207332 | 1788 | 1803 | 7176 | 7191 | $C_{ks}T_{ks}G_{ds}A_{ds}T_{ds}G_{ds}A_{ds}T_{ds}G_{ds}G_{ds}C_{ds}C_{ds}T_{ks}T_{es}G_{ks}{}^mC_{es}A_k$ | 29 | 3679 |
| 1207340 | 1894 | 1909 | 7282 | 7297 | $G_{ks}T_{ks}{}^mC_{ds}{}^mC_{ds}{}^mC_{ds}T_{ds}G_{ds}A_{ds}G_{ds}{}^mC_{ds}A_{ds}A_{ks}T_{es}{}^mC_{ks}A_{es}G_k$ | 57 | 3682 |
| 1207348 | 1902 | 1917 | 7290 | 7305 | $A_{ks}A_{ks}A_{ds}G_{ds}A_{ds}T_{ds}G_{ds}A_{ds}G_{ds}T_{ds}C_{ds}C_{ks}C_{es}T_{ks}G_{es}A_k$ | 32 | 2768 |

TABLE 80-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207356 | 1917 | 1932 | 7305 | 7320 | $A_{ks}A_{ks}T_{ds}{}^mC_{ds}A_{ds}{}^mC_{ds}{}^mC_{ds}A_{ds}A_{ds}G_{ds}G_{ds}A_{ks}G_{es}G_{ks}G_{es}A_k$ | 57 | 4956 |
| 1207364 | 1925 | 1940 | 7313 | 7328 | ${}^mC_{ks}A_{ks}{}^mC_{ds}T_{ds}G_{ds}{}^mC_{ds}G_{ds}G_{ds}A_{ds}A_{ds}T_{ds}{}^mC_{ks}A_{es}{}^mC_{ks}{}^mC_{es}A_k$ | 14 | 3683 |
| 1207372 | 1933 | 1948 | 7321 | 7336 | $C_{ks}A_{ks}C_{ds}T_{ds}C_{ds}T_{ds}C_{ds}T_{ds}C_{ds}A_{ds}{}^mC_{ds}T_{ks}G_{es}{}^mC_{ks}G_{es}G_k$ | 20 | 4957 |
| 1207380 | 2003 | 2018 | 7391 | 7406 | $C_{ks}T_{ks}G_{ds}C_{ds}G_{ds}{}^mC_{ds}C_{ds}A_{ds}T_{ds}C_{ds}{}^mC_{ds}T_{ks}G_{es}G_{ks}{}^mC_{es}G_k$ | 50 | 3381 |
| 1207388 | 2011 | 2026 | 7399 | 7414 | $T_{ks}T_{ks}G_{ds}A_{ds}G_{ds}T_{ds}T_{ds}{}^mC_{ds}{}^mC_{ds}T_{ds}G_{ds}{}^mC_{ks}G_{es}{}^mC_{ks}{}^mC_{es}A_k$ | 27 | 2463 |
| 1207396 | 2020 | 2035 | 7408 | 7423 | $A_{ks}G_{ks}{}^mC_{ds}A_{ds}{}^mC_{ds}T_{ds}T_{ds}T_{ds}A_{ds}T_{ds}T_{ds}G_{ks}A_{es}G_{ks}T_{es}T_k$ | 17 | 3076 |
| 1207404 | 142 | 157 | 509 | 524 | $G_{ks}T_{ks}G_{ks}{}^mC_{ds}T_{ds}{}^mC_{ds}T_{ds}T_{ds}{}^mC_{ds}A_{ds}G_{ds}{}^mC_{ds}T_{ks}T_{ks}T_{ks}G_e$ | 33 | 4958 |
| 1207412 | 150 | 165 | N/A | N/A | $A_{ks}{}^mC_{ks}G_{ks}A_{ds}{}^mC_{ds}T_{ds}G_{ds}T_{ds}G_{ds}T_{ds}G_{ds}G_{ds}C_{ds}T_{ks}C_{ks}T_{ks}T_e$ | 24 | 3495 |
| 1207420 | 158 | 173 | N/A | N/A | $C_{ks}A_{ks}G_{ks}T_{ds}G_{ds}A_{ds}G_{ds}A_{ds}A_{ds}C_{ds}G_{ds}A_{ds}C_{ks}T_{fes}G_{ks}T_e$ | 20 | 2579 |
| 1207428 | 215 | 230 | 3566 | 3581 | $A_{ks}T_{ks}T_{ks}T_{ds}G_{ds}T_{ds}G_{ds}G_{ds}T_{ds}A_{ds}C_{ds}A_{ds}G_{ks}{}^mC_{ks}T_{ks}G_e$ | 27 | 2963 |
| 1207436 | 223 | 238 | 3574 | 3589 | $G_{ks}T_{ks}G_{ks}G_{ds}G_{ds}T_{ds}A_{ds}{}^mC_{ds}A_{ds}T_{ds}T_{ds}T_{ds}G_{ks}T_{ks}G_{ks}G_e$ | 25 | 3497 |
| 1207444 | 1783 | 1798 | 7171 | 7186 | $G_{ks}A_{ks}T_{ks}G_{ds}C_{ds}C_{ds}T_{ds}T_{ds}G_{ds}C_{ds}A_{ds}G_{ds}G_{ks}G_{ks}T_{ks}G_e$ | 43 | 4959 |
| 1207452 | 1791 | 1806 | 7179 | 7194 | ${}^mC_{ks}A_{ks}G_{ks}{}^mC_{ds}T_{ds}G_{ds}A_{ds}T_{ds}G_{ds}G_{ds}A_{ds}T_{ds}G_{ds}{}^mC_{ks}{}^mC_{ks}T_{ks}T_e$ | 24 | 4960 |
| 1207460 | 1897 | 1912 | 7285 | 7300 | $T_{ks}G_{ks}A_{ks}G_{ds}T_{ds}{}^mC_{ds}{}^mC_{ds}{}^mC_{ds}T_{ds}G_{ds}A_{ds}G_{ds}C_{ks}A_{ks}A_{ks}T_e$ | 36 | 3910 |
| 1207468 | 1905 | 1920 | 7293 | 7308 | $G_{ks}G_{ks}G_{ks}A_{ds}A_{ds}A_{ds}G_{ds}A_{ds}T_{ds}G_{ds}A_{ds}G_{ds}T_{ks}{}^mC_{ks}{}^mC_{ks}{}^mC_e$ | 54 | 2997 |
| 1207476 | 1920 | 1935 | 7308 | 7323 | ${}^mC_{ks}G_{ks}G_{ks}A_{ds}A_{ds}T_{ds}{}^mC_{ds}A_{ds}{}^mC_{ds}{}^mC_{ds}A_{ds}A_{ds}G_{ks}G_{ks}A_{ks}G_e$ | 22 | 3303 |
| 1207484 | 1928 | 1943 | 7316 | 7331 | $T_{ks}C_{ks}T_{ks}{}^mC_{ds}A_{ds}C_{ds}T_{ds}G_{ds}C_{ds}G_{ds}G_{ds}A_{ds}A_{ks}T_{ks}C_{ks}A_e$ | 9 | 3911 |
| 1207492 | 1936 | 1951 | 7324 | 7339 | $A_{ks}G_{ks}{}^mC_{ks}{}^mC_{ds}A_{ds}{}^mC_{ds}T_{ds}{}^mC_{ds}T_{ds}{}^mC_{ds}T_{ds}{}^mC_{ds}A_{ks}{}^mC_{ks}T_{ks}G_e$ | 40 | 4961 |
| 1207500 | 2006 | 2021 | 7394 | 7409 | $T_{ks}T_{ks}{}^mC_{ks}{}^mC_{ds}T_{ds}G_{ds}{}^mC_{ds}G_{ds}G_{ds}{}^mC_{ds}{}^mC_{ds}A_{ds}T_{es}{}^mC_{ks}T_{ks}G_e$ | 33 | 3609 |
| 1207508 | 2014 | 2029 | 7402 | 7417 | $T_{ks}T_{ks}A_{ks}T_{ds}T_{ds}G_{ds}A_{ds}G_{ds}T_{ds}T_{ds}{}^mC_{ds}{}^mC_{ds}T_{ks}G_{ks}{}^mC_{ks}G_e$ | 17 | 2694 |
| 1207516 | 2023 | 2038 | 7411 | 7426 | ${}^mC_{ks}A_{ks}A_{ks}A_{ds}G_{ds}{}^mC_{ds}A_{ds}{}^mC_{ds}T_{ds}T_{ds}T_{ds}A_{ds}T_{ks}T_{ks}G_{ks}A_e$ | 5 | 3306 |

TABLE 81

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1129531 | 2009 | 2024 | 7397 | 7412 | $G_{ks}A_{ks}G_{ks}T_{ds}T_{ds}{}^mC_{ds}{}^mC_{ds}T_{ds}G_{ds}{}^mC_{ds}G_{ds}{}^mC_{ds}{}^mC_{ds}A_{ks}T_{ks}{}^mC_k$ | 13 | 3837 |
| 1206496 | 208 | 223 | 3559 | 3574 | $G_{ks}T_{ks}A_{ks}{}^mC_{ds}A_{ds}G_{ds}{}^mC_{ds}T_{ds}G_{ds}{}^mC_{ds}{}^mC_{ds}G_{ds}G_{ds}T_{ks}G_{ks}G_k$ | 27 | 4968 |
| 1206501 | 1786 | 1801 | 7174 | 7189 | $G_{ks}A_{ks}T_{ks}G_{ds}A_{ds}G_{ds}{}^mC_{ds}{}^mC_{ds}T_{ds}T_{ds}G_{ds}{}^mC_{ds}A_{ks}G_{ks}G_k$ | 48 | 4963 |
| 1206506 | 1918 | 1933 | 7306 | 7321 | $G_{ks}A_{ks}A_{ks}T_{ds}{}^mC_{ds}A_{ds}{}^mC_{ds}{}^mC_{ds}A_{ds}A_{ds}G_{ds}G_{ds}A_{ds}G_{ks}G_{ks}G_k$ | 10 | 4965 |
| 1206509 | 1937 | 1952 | 7325 | 7340 | ${}^mC_{ks}A_{ks}G_{ks}{}^mC_{ds}{}^mC_{ds}A_{ds}{}^mC_{ds}T_{ds}{}^mC_{ds}T_{ds}{}^mC_{ds}T_{ds}{}^mC_{ds}A_{ks}{}^mC_{ks}T_k$ | 6 | 4972 |
| 1206904 | 147 | 162 | 514 | 529 | $A_{ks}{}^mC_{es}T_{ks}G_{ds}T_{ds}G_{ds}T_{ds}G_{ds}{}^mC_{ds}T_{ds}{}^mC_{ds}T_{ds}T_{es}{}^mC_{es}A_{ks}G_k$ | 23 | 3267 |
| 1206912 | 155 | 170 | N/A | N/A | $T_{ks}G_{es}A_{ks}G_{ds}A_{ds}A_{ds}{}^mC_{ds}G_{ds}A_{ds}{}^mC_{ds}T_{ds}G_{ds}T_{es}G_{es}T_{ks}G_k$ | 23 | 3875 |
| 1206920 | 212 | 227 | 3563 | 3578 | $T_{ks}G_{es}T_{ks}G_{ds}T_{ds}G_{ds}{}^mC_{ds}A_{ds}A_{ds}G_{ds}{}^mC_{ds}T_{ds}G_{es}{}^mC_{es}{}^mC_{ks}G_k$ | 13 | 2734 |
| 1206928 | 220 | 235 | 3571 | 3586 | $G_{ks}G_{es}T_{ks}A_{ds}{}^mC_{ds}A_{ds}T_{ds}T_{ds}T_{ds}G_{ds}T_{ds}G_{ds}G_{es}T_{es}A_{ks}{}^mC_k$ | 45 | 3269 |
| 1206936 | 1780 | 1795 | 7168 | 7183 | $G_{ks}{}^mC_{es}{}^mC_{ks}T_{ds}T_{ds}G_{ds}{}^mC_{ds}A_{ds}G_{ds}G_{ds}G_{ds}T_{ds}G_{es}A_{Es}G_{ks}{}^mC_k$ | 48 | 3451 |
| 1206944 | 1788 | 1803 | 7176 | 7191 | ${}^mC_{ks}T_{es}G_{ks}A_{ds}T_{ds}G_{ds}A_{ds}T_{ds}G_{ds}{}^mC_{ds}{}^mC_{ds}T_{ds}T_{es}G_{es}{}^mC_{ks}A_k$ | 46 | 3679 |
| 1206952 | 1894 | 1909 | 7282 | 7297 | $G_{ks}T_{es}{}^mC_{ks}{}^mC_{ks}{}^mC_{ds}T_{ds}G_{ds}A_{ds}G_{ds}{}^mC_{ds}A_{ds}A_{ds}T_{es}{}^mC_{es}A_{ks}G_k$ | 19 | 3682 |
| 1206960 | 1902 | 1917 | 7290 | 7305 | $A_{ks}A_{es}A_{ks}G_{ds}A_{ds}T_{ds}G_{ds}A_{ds}A_{ds}G_{ds}T_{ds}{}^mC_{ds}{}^mC_{ds}{}^mC_{es}T_{es}G_{ks}A_k$ | 17 | 2768 |
| 1206968 | 1917 | 1932 | 7305 | 7320 | $A_{ks}A_{es}T_{ks}{}^mC_{ds}A_{ds}{}^mC_{ds}{}^mC_{ds}A_{ds}A_{ds}G_{ds}G_{ds}A_{ds}G_{es}G_{es}G_{ks}A_k$ | 41 | 4956 |
| 1206976 | 1925 | 1940 | 7313 | 7328 | ${}^mC_{ks}A_{es}{}^mC_{ks}T_{ds}G_{ds}{}^mC_{ds}G_{ds}G_{ds}A_{ds}A_{ds}T_{ds}{}^mC_{ds}A_{es}{}^mC_{es}{}^mC_{ks}A_k$ | 29 | 3683 |
| 1206984 | 1933 | 1948 | 7321 | 7336 | ${}^mC_{ks}A_{es}{}^mC_{ks}T_{ds}{}^mC_{ds}T_{ds}{}^mC_{ds}T_{ds}{}^mC_{ds}A_{ds}{}^mC_{ds}T_{ds}G_{es}{}^mC_{es}G_{ks}G_k$ | N.D | 4957 |
| 1206992 | 2003 | 2018 | 7391 | 7406 | ${}^mC_{ks}T_{es}G_{ks}{}^mC_{ds}G_{ds}{}^mC_{ds}{}^mC_{ds}A_{ds}T_{ds}{}^mC_{ds}{}^mC_{ds}T_{ds}G_{es}G_{es}{}^mC_{ks}G_k$ | 77 | 3381 |
| 1207000 | 2011 | 2026 | 7399 | 7414 | $T_{ks}T_{es}G_{ks}A_{ds}G_{ds}T_{ds}T_{ds}{}^mC_{ds}{}^mC_{ds}T_{ds}G_{ds}{}^mC_{ds}G_{es}{}^mC_{es}{}^mC_{ks}A_k$ | 11 | 2463 |
| 1207008 | 2020 | 2035 | 7408 | 7423 | $A_{ks}G_{es}{}^mC_{ks}A_{ds}{}^mC_{ds}T_{ds}T_{ds}T_{ds}A_{ds}T_{ds}T_{ds}G_{ds}A_{es}G_{es}T_{ks}T_k$ | 5 | 3076 |
| 1207027 | 142 | 157 | 509 | 524 | $G_{ks}T_{ks}G_{ds}{}^mC_{ds}T_{ds}{}^mC_{ds}T_{ds}T_{ds}{}^mC_{ds}A_{ds}G_{ds}{}^mC_{es}T_{es}T_{es}T_{ks}G_k$ | 40 | 4958 |
| 1207035 | 150 | 165 | N/A | N/A | $A_{ks}{}^mC_{ks}G_{ds}A_{ds}{}^mC_{ds}T_{ds}G_{ds}T_{ds}G_{ds}T_{ds}G_{ds}{}^mC_{es}T_{es}{}^mC_{es}T_{ks}T_k$ | 35 | 3495 |
| 1207043 | 158 | 173 | N/A | N/A | ${}^mC_{ks}A_{ks}G_{ds}T_{ds}G_{ds}A_{ds}A_{ds}G_{ds}A_{ds}{}^mC_{ds}G_{ds}A_{es}{}^mC_{es}T_{es}G_{ks}T_k$ | 36 | 2579 |
| 1207051 | 215 | 230 | 3566 | 3581 | $A_{ks}T_{ks}T_{ds}T_{ds}G_{ds}T_{ds}G_{ds}G_{ds}T_{ds}A_{ds}{}^mC_{ds}A_{es}G_{es}{}^mC_{es}T_{ks}G_k$ | 43 | 2963 |
| 1207059 | 223 | 238 | 3574 | 3589 | $G_{ks}T_{ks}G_{ds}G_{ds}G_{ds}T_{ds}A_{ds}{}^mC_{ds}A_{ds}T_{ds}T_{ds}T_{es}G_{es}T_{es}G_{ks}G_k$ | 25 | 3497 |

TABLE 81-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207079 | 1783 | 1798 | 7171 | 7186 | $G_{ks}A_{ks}T_{ds}G_{ds}{}^mC_{ds}{}^mC_{ds}T_{ds}T_{ds}G_{ds}{}^mC_{ds}A_{ds}G_{es}G_{es}G_{es}T_{ks}G_k$ | 37 | 4959 |
| 1207088 | 1791 | 1806 | 7179 | 7194 | ${}^mC_{ks}A_{ks}G_{ds}{}^mC_{ds}T_{ds}G_{ds}A_{ds}T_{ds}G_{ds}A_{ds}T_{ds}G_{es}{}^mC_{es}{}^mC_{es}T_{ks}T_k$ | 40 | 4960 |
| 1207096 | 1897 | 1912 | 7285 | 7300 | $T_{ks}G_{ks}A_{ds}G_{ds}T_{ds}{}^mC_{ds}{}^mC_{ds}{}^mC_{ds}T_{ds}G_{ds}A_{ds}G_{es}{}^mC_{es}A_{es}A_{ks}T_k$ | 27 | 3910 |
| 1207104 | 1905 | 1920 | 7293 | 7308 | $G_{ks}G_{ks}G_{ds}A_{ds}A_{ds}A_{ds}G_{ds}A_{ds}T_{ds}G_{ds}A_{ds}G_{es}T_{es}{}^mC_{es}{}^mC_{ks}{}^mC_k$ | 31 | 2997 |
| 1207112 | 1920 | 1935 | 7308 | 7323 | ${}^mC_{ks}G_{ds}G_{ds}A_{ds}A_{ds}T_{ds}{}^mC_{ds}A_{ds}{}^mC_{ds}{}^mC_{ds}A_{ds}A_{es}G_{es}G_{es}A_{ks}G_k$ | 19 | 3303 |
| 1207123 | 1928 | 1943 | 7316 | 7331 | $T_{ks}{}^mC_{ks}T_{ds}{}^mC_{ds}A_{ds}{}^mC_{ds}T_{ds}G_{ds}{}^mC_{ds}G_{ds}G_{ds}A_{es}A_{es}T_{es}{}^mC_{ks}A_k$ | 7 | 3911 |
| 1207139 | 1936 | 1951 | 7324 | 7339 | $A_{ks}G_{ks}{}^mC_{ds}{}^mC_{ds}A_{ds}{}^mC_{ds}T_{ds}{}^mC_{ds}T_{ds}{}^mC_{ds}T_{ds}{}^mC_{es}A_{es}{}^mC_{es}T_{ks}G_k$ | 7 | 4961 |
| 1207149 | 2006 | 2021 | 7394 | 7409 | $T_{ks}T_{ks}{}^mC_{ds}{}^mC_{ds}T_{ds}G_{ds}{}^mC_{ds}G_{ds}{}^mC_{ds}{}^mC_{ds}A_{ds}T_{Es}{}^mC_{es}{}^mC_{es}T_{ks}G_k$ | 13 | 3609 |
| 1207157 | 2014 | 2029 | 7402 | 7417 | $T_{ks}T_{ks}A_{ds}T_{ds}T_{ds}G_{ds}A_{ds}G_{ds}T_{ds}T_{ds}{}^mC_{ds}{}^mC_{es}T_{es}G_{es}{}^mC_{ks}G_k$ | 15 | 2694 |
| 1207165 | 2023 | 2038 | 7411 | 7426 | ${}^mC_{ks}A_{ks}A_{ds}A_{ds}G_{ds}{}^mC_{ds}A_{ds}{}^mC_{ds}T_{ds}T_{ds}T_{ds}A_{es}T_{es}G_{ks}A_k$ | 18 | 3306 |
| 1207173 | 145 | 160 | 512 | 527 | $T_{ks}G_{ks}T_{ds}G_{ds}T_{ds}G_{ds}{}^mC_{ds}T_{ds}{}^mC_{ds}T_{ds}T_{ds}{}^mC_{es}A_{ks}G_{es}{}^mC_{ks}T_e$ | 12 | 3112 |
| 1207181 | 153 | 168 | N/A | N/A | $A_{ks}G_{ks}A_{ds}A_{ds}{}^mC_{ds}G_{ds}A_{ds}{}^mC_{ds}T_{ds}G_{ds}T_{ds}G_{es}T_{ks}G_{es}{}^mC_{ks}T_e$ | 53 | 3723 |
| 1207189 | 210 | 225 | 3561 | 3576 | $T_{ks}G_{ks}G_{ds}T_{ds}A_{ds}{}^mC_{ds}A_{ds}G_{ds}{}^mC_{ds}T_{ds}G_{ds}{}^mC_{es}{}^mC_{ks}G_{es}G_{ks}T_e$ | 30 | 2657 |
| 1207197 | 218 | 233 | 3569 | 3584 | $T_{ks}A_{ks}{}^mC_{ds}A_{ds}T_{ds}T_{ds}T_{ds}G_{ds}T_{ds}G_{ds}G_{ds}T_{es}A_{ks}{}^mC_{es}A_{ks}G_e$ | 14 | 2426 |
| 1207205 | 1778 | 1793 | 7166 | 7181 | ${}^mC_{ks}T_{ks}T_{ds}G_{ds}{}^mC_{ds}A_{ds}G_{ds}G_{ds}G_{ds}T_{ds}G_{ds}A_{es}G_{ks}{}^mC_{es}{}^mC_{ks}G_e$ | 48 | 4962 |
| 1207213 | 1786 | 1801 | 7174 | 7189 | $G_{ks}A_{ks}T_{ds}G_{ds}A_{ds}T_{ds}G_{ds}{}^mC_{ds}{}^mC_{ds}T_{ds}T_{ds}G_{es}{}^mC_{ks}A_{es}G_{ks}G_e$ | 16 | 4963 |
| 1207221 | 1892 | 1907 | 7280 | 7295 | ${}^mC_{ks}{}^mC_{ks}{}^mC_{ds}T_{ds}G_{ds}A_{ds}G_{ds}{}^mC_{ds}A_{ds}A_{ds}T_{ds}{}^mC_{es}A_{ks}G_{es}G_{ks}A_e$ | 53 | 3530 |
| 1207229 | 1900 | 1915 | 7288 | 7303 | $A_{ks}G_{ks}A_{ds}T_{ds}G_{ds}A_{ds}G_{ds}T_{ds}{}^mC_{ds}{}^mC_{ds}{}^mC_{ds}T_{es}G_{ks}A_{es}G_{ks}{}^mC_e$ | 14 | 2614 |
| 1207237 | 1915 | 1930 | 7303 | 7318 | $T_{ks}{}^mC_{ks}A_{ds}{}^mC_{ds}{}^mC_{ds}A_{ds}A_{ds}G_{ds}G_{ds}A_{ds}G_{ds}G_{es}G_{ks}A_{es}A_{ks}A_e$ | 30 | 4948 |
| 1207245 | 1923 | 1938 | 7311 | 7326 | ${}^mC_{ks}T_{ks}G_{ds}{}^mC_{ds}G_{ds}G_{ds}A_{ds}A_{ds}T_{ds}{}^mC_{ds}A_{ds}{}^mC_{es}{}^mC_{ks}A_{es}A_{ks}G_e$ | 11 | 3531 |
| 1207253 | 1931 | 1946 | 7319 | 7334 | ${}^mC_{ks}T_{ks}{}^mC_{ds}T_{ds}{}^mC_{ds}T_{ds}{}^mC_{ds}A_{ds}{}^mC_{ds}T_{ds}G_{ds}{}^mC_{es}G_{ks}G_{es}A_{ks}A_e$ | 9 | 2461 |
| 1207261 | 2001 | 2016 | 7389 | 7404 | $G_{ks}{}^mC_{ks}G_{ds}{}^mC_{ds}{}^mC_{ds}A_{ds}T_{ds}{}^mC_{ds}{}^mC_{ds}T_{ds}G_{ds}{}^mC_{es}{}^mC_{ks}G_{es}{}^mC_{ks}G_e$ | 56 | 4964 |
| 1207269 | 2009 | 2024 | 7397 | 7412 | $G_{ks}A_{ks}G_{ds}T_{ds}T_{ds}{}^mC_{ds}{}^mC_{ds}T_{ds}G_{ds}{}^mC_{ds}G_{ds}{}^mC_{es}{}^mC_{es}A_{es}T_{ks}{}^mC_e$ | 11 | 3837 |
| 1207277 | 2018 | 2033 | 7406 | 7421 | ${}^mC_{ks}A_{ks}{}^mC_{ds}T_{ds}T_{ds}T_{ds}A_{ds}T_{ds}G_{ds}A_{ds}G_{es}T_{ks}T_{es}{}^mC_{ks}{}^mC_e$ | 6 | 2924 |

TABLE 81-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207285 | 2033 | 2048 | 7421 | 7436 | $T_{ks}{}^mC_{ks}A_{ds}G_{ds}{}^mC_{ds}A_{ds}T_{ds}T_{ds}T_{ds}T_{ds}{}^mC_{ds}A_{es}A_{ks}A_{es}G^mC_e$ | 36 | 3534 |
| 1207293 | 148 | 163 | 515 | 530 | $G_{ks}A_{ks}{}^mC_{ds}T_{ds}G_{ds}T_{ds}G_{ds}T_{ds}G_{ds}{}^mC_{ds}T_{ds}{}^mC_{ks}T_{es}T_{ks}{}^mC_{es}A_k$ | 12 | 3343 |
| 1207301 | 156 | 171 | N/A | N/A | $G_{ks}T_{ks}G_{ds}A_{ds}G_{ds}A_{ds}A_{ds}{}^mC_{ds}G_{ds}A_{ds}{}^mC_{ds}T_{ks}G_{es}T_{ks}G_{es}T_k$ | 29 | 2424 |
| 1207309 | 213 | 228 | 3564 | 3579 | $T_{ks}T_{ks}G_{ds}T_{ds}G_{ds}G_{ds}T_{ds}A_{ds}{}^mC_{ds}A_{ds}G_{ds}{}^mC_{ks}T_{es}G_{ks}{}^mC_{es}{}^mC_k$ | 21 | 2811 |
| 1207317 | 221 | 236 | 3572 | 3587 | $G_{ks}G_{ks}G_{ds}T_{ds}A_{ds}{}^mC_{ds}A_{ds}T_{ds}T_{ds}T_{ds}G_{ds}T_{ks}G_{es}G_{ks}T_{es}A_k$ | 46 | 3345 |
| 1207325 | 1781 | 1796 | 7169 | 7184 | $T_{ks}G_{ks}{}^mC_{ds}{}^mC_{ds}T_{ds}T_{ds}G_{ds}{}^mC_{ds}A_{ds}G_{ds}G_{ds}G_{ks}T_{es}G_{ks}A_{es}G_k$ | 28 | 3527 |
| 1207333 | 1789 | 1804 | 7177 | 7192 | $G_{ks}{}^mC_{ks}T_{ds}G_{ds}A_{ds}T_{ds}G_{ds}A_{ds}T_{ds}G_{ds}{}^mC_{ds}{}^mC_{ks}T_{es}T_{ks}G_{es}{}^mC_k$ | 26 | 3755 |
| 1207341 | 1895 | 1910 | 7283 | 7298 | $A_{ks}G_{ks}T_{ds}{}^mC_{ds}{}^mC_{ds}{}^mC_{ds}T_{ds}G_{ds}A_{ds}G_{ds}{}^mC_{ds}A_{es}T_{ks}{}^mC_{es}A_k$ | 27 | 3758 |
| 1207349 | 1903 | 1918 | 7291 | 7306 | $G_{ks}A_{ks}A_{ds}A_{ds}G_{ds}A_{ds}T_{ds}G_{ds}A_{ds}G_{ds}T_{ds}{}^mC_{ks}{}^mC_{es}{}^mC_{ks}T_{es}G_k$ | 29 | 2845 |
| 1207357 | 1918 | 1933 | 7306 | 7321 | $G_{ks}A_{ks}A_{ds}T_{ds}{}^mC_{ds}A_{ds}{}^mC_{ds}{}^mC_{ds}A_{ds}A_{ds}G_{ds}G_{ks}A_{es}G_{ks}G_{es}G_k$ | 35 | 4965 |
| 1207365 | 1926 | 1941 | 7314 | 7329 | $T_{ks}{}^mC_{ks}A_{ds}{}^mC_{ds}T_{ds}G_{ds}{}^mC_{ds}G_{ds}G_{ds}A_{ds}A_{ds}T_{ks}{}^mC_{es}A_{ks}{}^mC_{es}{}^mC_k$ | 10 | 3759 |
| 1207373 | 1934 | 1949 | 7322 | 7337 | ${}^mC_{ks}{}^mC_{ks}A_{ds}{}^mC_{ds}T_{ds}{}^mC_{ds}T_{ds}{}^mC_{ds}T_{ds}{}^mC_{ds}A_{ds}{}^mC_{ks}T_{es}G_{ks}{}^mC_{es}G_k$ | 23 | 4949 |
| 1207381 | 2004 | 2019 | 7392 | 7407 | ${}^mC_{ks}{}^mC_{ks}T_{ds}G_{ds}{}^mC_{ds}G_{ds}G_{ds}{}^mC_{ds}{}^mC_{ds}A_{ds}T_{ds}{}^mC_{ks}T_{es}G_{ks}G_{es}{}^mC_k$ | 9 | 3457 |
| 1207389 | 2012 | 2027 | 7400 | 7415 | $A_{ks}T_{ks}T_{ds}G_{ds}A_{ds}G_{ds}T_{ds}T_{ds}{}^mC_{ds}{}^mC_{ds}T_{ds}G_{ks}{}^mC_{es}G_{ks}{}^mC_{es}{}^mC_k$ | 44 | 2540 |
| 1207397 | 2021 | 2036 | 7409 | 7424 | $A_{ks}A_{ks}G_{ds}{}^mC_{ds}A_{ds}{}^mC_{ds}T_{ds}T_{ds}T_{ds}A_{ds}T_{ds}T_{ks}G_{es}A_{ks}G_{es}T_k$ | 22 | 3147 |
| 1207405 | 143 | 158 | 510 | 525 | $T_{ks}G_{ks}T_{ks}G_{ds}{}^mC_{ds}T_{ds}{}^mC_{ds}T_{ds}T_{ds}{}^mC_{ds}A_{ds}G_{ds}{}^mC_{ks}T_{ks}T_{ks}T_e$ | 29 | 3037 |
| 1207413 | 151 | 166 | N/A | N/A | $A_{ks}A_{ks}{}^mC_{ks}G_{ds}A_{ds}{}^mC_{ds}T_{ds}G_{ds}T_{ds}G_{ds}T_{ds}G_{ds}{}^mC_{ks}T_{ks}{}^mC_{ks}T_e$ | 24 | 3571 |
| 1207421 | 208 | 223 | 3559 | 3574 | $G_{ks}T_{ks}A_{ks}{}^mC_{ds}A_{ds}G_{ds}{}^mC_{ds}T_{ds}G_{ds}{}^mC_{ds}{}^mC_{ds}G_{ds}G_{ks}T_{ks}G_{ks}G_e$ | 25 | 4968 |
| 1207429 | 216 | 231 | 3567 | 3582 | ${}^mC_{ks}A_{ks}T_{ks}T_{ds}T_{ds}G_{ds}T_{ds}G_{ds}G_{ds}T_{ds}A_{ds}{}^mC_{ds}A_{ks}G_{ks}{}^mC_{ks}T_e$ | 14 | 3039 |
| 1207437 | 1776 | 1791 | 7164 | 7179 | $T_{ks}G_{ks}{}^mC_{ds}A_{ds}G_{ds}G_{ds}T_{ds}G_{ds}G_{ds}A_{ds}G_{ds}{}^mC_{ds}{}^mC_{ks}G_{ks}G_{ks}{}^mC_e$ | 37 | 3299 |
| 1207445 | 1784 | 1799 | 7172 | 7187 | $T_{ks}G_{ks}A_{ks}T_{ds}G_{ds}{}^mC_{ds}{}^mC_{ds}T_{ds}T_{ds}G_{ds}{}^mC_{ds}A_{ds}G_{ks}G_{ks}G_{ks}T_e$ | 36 | 4969 |
| 1207453 | 1792 | 1807 | 7180 | 7195 | ${}^mC_{ks}{}^mC_{ks}A_{ks}G_{ds}{}^mC_{ds}T_{ds}G_{ds}G_{ds}A_{ds}T_{ds}G_{ds}A_{ds}T_{ks}G_{ks}{}^mC_{ks}T_e$ | 28 | 4970 |
| 1207461 | 1898 | 1913 | 7286 | 7301 | $A_{ks}T_{ks}G_{ks}A_{ds}G_{ds}T_{ds}{}^mC_{ds}{}^mC_{ds}{}^mC_{ds}T_{ds}G_{ds}A_{ds}G_{ks}{}^mC_{ks}A_{ks}A_e$ | 21 | 2460 |
| 1207469 | 1906 | 1921 | 7294 | 7309 | $A_{ks}G_{ks}G_{ks}G_{ds}A_{ds}A_{ds}A_{ds}G_{ds}A_{ds}T_{ds}G_{ds}A_{ds}G_{ks}T_{ks}{}^mC_{ks}{}^mC_e$ | 15 | 3073 |

TABLE 81-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207477 | 1921 | 1936 | 7309 | 7324 | $G_{ks}{}^mC_{ks}G_{ks}G_{ds}A_{ds}A_{ds}T_{ds}{}^mC_{ds}A_{ds}{}^mC_{ds}{}^mC_{ds}A_{ds}A_{ks}G_{ks}G_{ks}A_e$ | 15 | 3379 |
| 1207485 | 1929 | 1944 | 7317 | 7332 | ${}^mC_{ks}T_{ks}{}^mC_{ks}T_{ds}{}^mC_{ds}A_{ds}{}^mC_{ds}T_{ds}G_{ds}{}^mC_{ds}G_{ds}G_{ds}A_{ks}A_{ks}T_{ks}{}^mC_e$ | 12 | 4971 |
| 1207493 | 1937 | 1952 | 7325 | 7340 | ${}^mC_{ks}A_{ks}G_{ks}{}^mC_{ds}{}^mC_{ds}A_{ds}{}^mC_{ds}T_{ds}{}^mC_{ds}T_{ds}{}^mC_{ds}T_{ds}{}^mC_{ks}A_{ks}{}^mC_{ks}T_e$ | 14 | 4972 |
| 1207501 | 2007 | 2022 | 7395 | 7410 | $G_{ks}T_{ks}T_{ks}{}^mC_{ds}{}^mC_{ds}T_{ds}G_{ds}{}^mC_{ds}G_{ds}{}^mC_{ds}{}^mC_{ds}A_{ds}T_{ks}{}^mC_{ks}{}^mC_{ks}T_e$ | 21 | 3685 |
| 1207509 | 2016 | 2031 | 7404 | 7419 | ${}^mC_{ks}T_{ks}T_{ks}T_{ds}A_{ds}T_{ds}T_{ds}G_{ds}A_{ds}G_{ds}T_{ds}T_{ds}{}^mC_{ks}{}^mC_{ks}T_{ks}G_e$ | 8 | 2771 |
| 1207517 | 2024 | 2039 | 7412 | 7427 | $T_{ks}{}^mC_{ks}A_{ks}A_{ds}A_{ds}G_{ds}{}^mC_{ds}A_{ds}{}^mC_{ds}T_{ds}T_{ds}T_{ds}A_{ks}T_{ks}T_{ks}G_e$ | 11 | 3382 |

TABLE 82

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1129531 | 2009 | 2024 | 7397 | 7412 | $G_{ks}A_{ks}G_{ks}T_{ds}T_{ds}{}^mC_{ds}{}^mC_{ds}T_{ds}G_{ds}{}^mC_{ds}G_{ds}{}^mC_{ds}{}^mC_{ds}A_{ks}T_{ks}{}^mC_k$ | 12 | 3837 |
| 1206479 | 209 | 224 | 3560 | 3575 | $G_{ks}G_{ks}T_{ks}A_{ds}{}^mC_{ds}A_{ds}G_{ds}{}^mC_{ds}T_{ds}G_{ds}{}^mC_{ds}G_{ds}G_{ks}T_{ks}G_k$ | 20 | 4952 |
| 1206502 | 1787 | 1802 | 7175 | 7190 | $T_{ks}G_{ks}A_{ks}T_{ds}G_{ds}A_{ds}T_{ds}G_{ds}{}^mC_{ds}{}^mC_{ds}T_{ds}T_{ds}G_{ds}{}^mC_{ks}A_{ks}G_k$ | 27 | 4975 |
| 1206507 | 1929 | 1944 | 7317 | 7332 | ${}^mC_{ks}T_{ks}{}^mC_{ks}T_{ds}{}^mC_{ds}A_{ds}{}^mC_{ds}T_{ds}G_{ds}{}^mC_{ds}G_{ds}G_{ds}A_{ks}A_{ks}T_{ks}{}^mC_k$ | 11 | 4971 |
| 1206897 | 2001 | 2016 | 7389 | 7404 | $G_{ks}{}^mC_{ks}G_{ks}{}^mC_{ds}A_{ds}T_{ds}{}^mC_{ds}{}^mC_{ds}T_{ds}G_{ds}G_{ds}{}^mC_{ds}G_{ks}{}^mC_{ks}G_k$ | 41 | 4964 |
| 1206905 | 148 | 163 | 515 | 530 | $G_{ks}A_{es}{}^mC_{ks}T_{ds}G_{ds}T_{ds}G_{ds}T_{ds}G_{ds}{}^mC_{ds}T_{ds}{}^mC_{ds}T_{es}T_{es}{}^mC_{ks}A_k$ | 10 | 3343 |
| 1206913 | 156 | 171 | N/A | N/A | $G_{ks}T_{es}G_{ks}A_{ds}G_{ds}A_{ds}A_{ds}{}^mC_{ds}G_{ds}A_{ds}{}^mC_{ds}T_{ds}T_{es}T_{es}G_{ks}T_k$ | 21 | 2424 |
| 1206921 | 213 | 228 | 3564 | 3579 | $T_{ks}T_{es}G_{ks}T_{ds}G_{ds}G_{ds}T_{ds}A_{ds}{}^mC_{ds}A_{ds}G_{ds}{}^mC_{ds}T_{es}G_{es}{}^mC_{ks}{}^mC_k$ | 21 | 2811 |
| 1206929 | 221 | 236 | 3572 | 3587 | $G_{ks}G_{es}G_{ks}T_{ds}A_{ds}{}^mC_{ds}A_{ds}A_{ds}T_{ds}T_{ds}G_{ds}T_{ds}G_{es}G_{es}T_{ks}A_k$ | 22 | 3345 |
| 1206937 | 1781 | 1796 | 7169 | 7184 | $T_{ks}G_{es}{}^mC_{ks}{}^mC_{ds}T_{ds}T_{ds}G_{ds}{}^mC_{ds}A_{ds}G_{ds}G_{ds}G_{ds}T_{es}G_{es}A_{ks}G_k$ | 58 | 3527 |
| 1206945 | 1789 | 1804 | 7177 | 7192 | $G_{ks}{}^mC_{es}T_{ks}G_{ds}A_{ds}T_{ds}G_{ds}A_{ds}T_{ds}G_{ds}{}^mC_{ds}{}^mC_{ds}T_{es}T_{es}G_{ks}{}^mC_k$ | 23 | 3755 |
| 1206953 | 1895 | 1910 | 7283 | 7298 | $A_{ks}G_{es}T_{ks}{}^mC_{ds}{}^mC_{ds}{}^mC_{ds}T_{ds}G_{ds}G_{ds}A_{ds}G_{ds}{}^mC_{ds}A_{es}A_{es}T_{es}{}^mC_{ks}A_k$ | 8 | 3758 |
| 1206961 | 1903 | 1918 | 7291 | 7306 | $G_{ks}A_{es}A_{ks}A_{ds}G_{ds}A_{ds}T_{ds}G_{ds}G_{ds}A_{ds}G_{ds}T_{ds}{}^mC_{ds}{}^mC_{es}{}^mC_{es}T_{ks}G_k$ | 17 | 2845 |
| 1206969 | 1918 | 1933 | 7306 | 7321 | $G_{ks}A_{es}A_{ks}T_{ds}{}^mC_{ds}A_{ds}{}^mC_{ds}{}^mC_{ds}A_{ds}A_{ds}G_{ds}G_{ds}A_{es}G_{es}{}^mC_{ks}G_k$ | 18 | 4965 |

TABLE 82-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1206977 | 1926 | 1941 | 7314 | 7329 | $T_{ks}C_{es}A_{ks}C_{ds}T_{ds}G_{ds}C_{ds}G_{ds}G_{ds}A_{ds}A_{ds}T_{ds}{}^mC_{es}A_{es}{}^mC_{ks}{}^mC_k$ | 12 | 3759 |
| 1206985 | 1934 | 1949 | 7322 | 7337 | ${}^mC_{ks}{}^mC_{es}A_{ks}{}^mC_{ds}T_{ds}{}^mC_{ds}T_{ds}{}^mC_{ds}T_{ds}{}^mC_{ds}A_{ds}{}^mC_{ds}T_{es}G_{es}{}^mC_{ks}G_k$ | 13 | 4949 |
| 1206993 | 2004 | 2019 | 7392 | 7407 | ${}^mC_{ks}{}^mC_{es}T_{ks}G_{ds}{}^mC_{ds}G_{ds}{}^mC_{ds}{}^mC_{ds}A_{ds}T_{ds}{}^mC_{ds}{}^mC_{ds}T_{es}G_{es}G_{ks}{}^mC_k$ | 7 | 3457 |
| 1207001 | 2012 | 2027 | 7400 | 7415 | $A_{ks}T_{es}T_{ks}G_{ds}A_{ds}G_{ds}T_{ds}T_{ds}{}^mC_{ds}{}^mC_{ds}T_{ds}G_{ds}T_{es}G_{es}T_{ks}T_k$ | 28 | 2540 |
| 1207009 | 2021 | 2036 | 7409 | 7424 | $A_{ks}A_{es}G_{ks}{}^mC_{ds}A_{ds}{}^mC_{ds}T_{ds}T_{ds}A_{ds}T_{ds}T_{ds}G_{es}A_{es}G_{ks}T_k$ | N.D | 3147 |
| 1207028 | 143 | 158 | 510 | 525 | $T_{ks}G_{ks}T_{ds}G_{ds}{}^mC_{ds}T_{ds}{}^mC_{ds}T_{ds}T_{ds}{}^mC_{ds}A_{ds}G_{es}{}^mC_{es}T_{es}T_{ks}T_k$ | 72 | 3037 |
| 1207036 | 151 | 166 | N/A | N/A | $A_{ks}A_{ks}{}^mC_{ds}G_{ds}A_{ds}{}^mC_{ds}T_{ds}G_{ds}T_{ds}G_{ds}T_{ds}G_{es}{}^mC_{es}T_{es}{}^mC_{ks}T_k$ | 19 | 3571 |
| 1207044 | 208 | 223 | 3559 | 3574 | $G_{ks}T_{ks}A_{ds}{}^mC_{ds}A_{ds}G_{ds}{}^mC_{ds}T_{ds}G_{ds}{}^mC_{ds}{}^mC_{ds}G_{es}G_{es}T_{es}G_{ks}G_k$ | 58 | 4968 |
| 1207052 | 216 | 231 | 3567 | 3582 | ${}^mC_{ks}A_{ks}T_{ds}T_{ds}T_{ds}G_{ds}T_{ds}G_{ds}G_{ds}G_{ds}T_{ds}A_{ds}C_{es}A_{es}G_{es}{}^mC_{ks}T_k$ | 24 | 3039 |
| 1207060 | 1776 | 1791 | 7164 | 7179 | $T_{ks}G_{ks}{}^mC_{ds}A_{ds}G_{ds}G_{ds}G_{ds}T_{ds}G_{ds}A_{ds}G_{ds}{}^mC_{es}{}^mC_{es}G_{es}G_{ks}{}^mC_k$ | 26 | 3299 |
| 1207081 | 1784 | 1799 | 7172 | 7187 | $T_{ks}G_{ks}A_{ds}T_{ds}G_{ds}{}^mC_{ds}{}^mC_{ds}T_{ds}T_{ds}G_{ds}{}^mC_{ds}A_{es}G_{es}G_{es}G_{ks}T_k$ | 39 | 4969 |
| 1207089 | 1792 | 1807 | 7180 | 7195 | ${}^mC_{ks}{}^mC_{ks}A_{ds}G_{ds}{}^mC_{ds}T_{ds}G_{ds}G_{ds}A_{ds}T_{ds}G_{ds}A_{ds}T_{es}G_{es}{}^mC_{ks}T_k$ | 45 | 4970 |
| 1207097 | 1898 | 1913 | 7286 | 7301 | $A_{ks}T_{es}G_{ds}A_{ds}G_{ds}T_{ds}{}^mC_{ds}{}^mC_{ds}{}^mC_{ds}T_{ds}G_{ds}A_{es}{}^mC_{es}A_{ks}A_k$ | 14 | 2460 |
| 1207105 | 1906 | 1921 | 7294 | 7309 | $A_{ks}G_{ks}G_{ds}G_{ds}A_{ds}A_{ds}A_{ds}G_{ds}A_{ds}T_{ds}G_{ds}A_{es}G_{es}T_{es}{}^mC_{ks}{}^mC_k$ | 25 | 3073 |
| 1207113 | 1921 | 1936 | 7309 | 7324 | $G_{ks}{}^mC_{ks}G_{ds}G_{ds}A_{ds}A_{ds}A_{ds}T_{ds}{}^mC_{ds}A_{ds}{}^mC_{ds}{}^mC_{ds}A_{es}G_{es}G_{ks}A_k$ | 8 | 3379 |
| 1207125 | 1929 | 1944 | 7317 | 7332 | ${}^mC_{ks}T_{ks}{}^mC_{ds}T_{ds}{}^mC_{ds}A_{ds}{}^mC_{ds}T_{ds}G_{ds}{}^mC_{ds}G_{ds}G_{es}A_{es}A_{es}T_{ks}{}^mC_k$ | 9 | 4971 |
| 1207141 | 1937 | 1952 | 7325 | 7340 | ${}^mC_{ks}A_{ks}G_{ds}{}^mC_{ds}{}^mC_{ds}A_{ds}{}^mC_{ds}T_{ds}{}^mC_{ds}T_{ds}{}^mC_{ds}T_{es}{}^mC_{es}A_{es}{}^mC_{ks}T_k$ | 28 | 4972 |
| 1207150 | 2007 | 2022 | 7395 | 7410 | $G_{ks}T_{ks}T_{ds}{}^mC_{ds}{}^mC_{ds}T_{ds}G_{ds}{}^mC_{ds}G_{ds}{}^mC_{ds}{}^mC_{ds}A_{es}T_{es}{}^mC_{es}{}^mC_{ks}T_k$ | 21 | 3685 |
| 1207158 | 2016 | 2031 | 7404 | 7419 | $C_{ks}T_{ks}T_{ds}T_{ds}A_{ds}T_{ds}T_{ds}G_{ds}A_{ds}G_{ds}T_{ds}T_{es}{}^mC_{es}{}^mC_{es}T_{ks}G_k$ | 27 | 2771 |
| 1207166 | 2024 | 2039 | 7412 | 7427 | $T_{ks}{}^mC_{ks}A_{ds}A_{ds}A_{ds}G_{ds}{}^mC_{ds}A_{ds}{}^mC_{ds}T_{ds}T_{ds}A_{es}T_{es}T_{ks}G_k$ | 22 | 3382 |
| 1207174 | 146 | 161 | 513 | 528 | ${}^mC_{ks}T_{ks}G_{ds}T_{ds}G_{ds}T_{ds}G_{ds}{}^mC_{ds}T_{ds}{}^mC_{ds}T_{ds}T_{es}{}^mC_{ks}A_{es}G_{ks}{}^mC_e$ | 28 | 3190 |
| 1207182 | 154 | 169 | N/A | N/A | $G_{ks}A_{ks}G_{ds}A_{ds}A_{ds}{}^mC_{ds}G_{ds}A_{ds}{}^mC_{ds}T_{ds}G_{ds}T_{es}G_{ks}T_{es}G_{ks}{}^mC_e$ | 16 | 3799 |
| 1207190 | 211 | 226 | 3562 | 3577 | $G_{ks}T_{ks}G_{ds}G_{ds}T_{ds}A_{ds}{}^mC_{ds}A_{ds}G_{ds}{}^mC_{ds}T_{ds}G_{es}{}^mC_{ks}{}^mC_{es}G_{ks}G_e$ | 5 | 4973 |
| 1207198 | 219 | 234 | 3570 | 3585 | $G_{ks}T_{ks}A_{ds}{}^mC_{ds}A_{ds}T_{ds}T_{ds}T_{ds}G_{ds}T_{ds}G_{ds}G_{es}T_{ks}A_{es}{}^mC_{ks}A_e$ | 48 | 3192 |

TABLE 82-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207206 | 1779 | 1794 | 7167 | 7182 | $^mC_{ks}{}^mC_{ks}T_{ds}T_{ds}G_{ds}{}^mC_{ds}A_{ds}G_{ds}G_{ds}G_{ds}T_{ds}G_{es}A_{ks}G_{es}{}^mC_{ks}{}^mC_e$ | 36 | 4974 |
| 1207214 | 1787 | 1802 | 7175 | 7190 | $T_{ks}G_{ks}A_{ds}T_{ds}G_{ds}A_{ds}T_{ds}G_{ds}{}^mC_{ds}{}^mC_{ds}T_{ds}T_{es}G_{ks}{}^mC_{es}A_{ks}G_e$ | 26 | 4975 |
| 1207222 | 1893 | 1908 | 7281 | 7296 | $T_{ks}{}^mC_{ks}{}^mC_{ds}{}^mC_{ds}T_{ds}G_{ds}A_{ds}G_{ds}{}^mC_{ds}A_{ds}A_{ds}T_{es}{}^mC_{ks}A_{es}G_{ks}G_e$ | 35 | 3606 |
| 1207230 | 1901 | 1916 | 7289 | 7304 | $A_{ks}A_{ks}G_{ds}A_{ds}T_{ds}G_{ds}A_{ds}G_{ds}T_{ds}{}^mC_{ds}{}^mC_{ds}{}^mC_{es}T_{ks}G_{es}A_{ks}G_e$ | 7 | 2691 |
| 1207238 | 1916 | 1931 | 7304 | 7319 | $A_{ks}T_{ks}{}^mC_{ds}A_{ds}{}^mC_{ds}{}^mC_{ds}A_{ds}A_{ds}G_{ds}G_{ds}A_{ds}G_{es}G_{ks}G_{es}A_{ks}A_e$ | 32 | 4966 |
| 1207246 | 1924 | 1939 | 7312 | 7327 | $A_{ks}{}^mC_{ks}T_{ds}G_{ds}{}^mC_{ds}G_{ds}G_{ds}A_{ds}A_{ds}T_{ds}{}^mC_{ds}A_{es}{}^mC_{ks}{}^mC_{es}A_{ks}A_e$ | 17 | 3607 |
| 1207254 | 1932 | 1947 | 7320 | 7335 | $A_{ks}{}^mC_{ks}T_{ds}{}^mC_{ds}T_{ds}{}^mC_{ds}T_{ds}{}^mC_{ds}A_{ds}{}^mC_{ds}T_{ds}G_{es}{}^mC_{ks}G_{es}G_{ks}A_e$ | 18 | 4976 |
| 1207262 | 2002 | 2017 | 7390 | 7405 | $T_{ks}G_{ks}{}^mC_{ds}G_{ds}{}^mC_{ds}{}^mC_{ds}A_{ds}T_{ds}{}^mC_{ds}{}^mC_{ds}T_{ds}G_{es}G_{ks}{}^mC_{es}G_{ks}{}^mC_e$ | 37 | 3305 |
| 1207270 | 2010 | 2025 | 7398 | 7413 | $T_{ks}G_{ks}A_{ds}G_{ds}T_{ds}T_{ds}{}^mC_{ds}{}^mC_{ds}T_{ds}G_{ds}{}^mC_{ds}G_{es}{}^mC_{ks}T_{es}A_{ks}T_e$ | 21 | 3913 |
| 1207278 | 2019 | 2034 | 7407 | 7422 | $G_{ks}{}^mC_{ks}A_{ds}{}^mC_{ds}T_{ds}T_{ds}T_{ds}A_{ds}T_{ds}T_{ds}G_{ds}A_{es}G_{ks}T_{es}T_{ks}{}^mC_e$ | 7 | 3000 |
| 1207286 | 141 | 156 | 508 | 523 | $T_{ks}G_{ks}{}^mC_{ds}T_{ds}{}^mC_{ds}T_{ds}T_{ds}{}^mC_{ds}A_{ds}G_{ds}{}^mC_{ds}T_{es}T_{ks}G_{es}T_k$ | 27 | 4950 |
| 1207294 | 149 | 164 | 516 | 531 | $^mC_{ks}G_{ks}A_{ds}{}^mC_{ds}T_{ds}G_{ds}T_{ds}G_{ds}T_{ds}G_{ds}{}^mC_{ds}T_{ks}{}^mC_{es}T_{es}{}^mC_k$ | 21 | 3419 |
| 1207302 | 157 | 172 | N/A | N/A | $A_{ks}G_{ks}T_{ds}G_{ds}A_{ds}G_{ds}A_{ds}A_{ds}{}^mC_{ds}G_{ds}A_{ds}{}^mC_{ks}T_{es}G_{ks}T_{es}G_k$ | 38 | 2502 |
| 1207310 | 214 | 229 | 3565 | 3580 | $T_{ks}T_{ks}T_{ds}G_{ds}T_{ds}G_{ds}G_{ds}G_{ds}T_{ds}A_{ds}{}^mC_{ds}A_{ds}G_{ks}{}^mC_{es}T_{ks}G_{es}{}^mC_k$ | 26 | 2887 |
| 1207318 | 222 | 237 | 3573 | 3588 | $T_{ks}G_{ks}G_{ds}G_{ds}G_{ds}T_{ds}A_{ds}{}^mC_{ds}A_{ds}T_{ds}T_{ds}T_{ds}G_{ks}T_{es}G_{ks}G_{es}T_k$ | 30 | 3421 |
| 1207326 | 1782 | 1797 | 7170 | 7185 | $A_{ks}T_{ks}G_{ds}{}^mC_{ds}{}^mC_{ds}T_{ds}T_{ds}G_{ds}{}^mC_{ds}A_{ds}G_{ds}G_{ks}G_{es}T_{ks}G_{es}A_k$ | 34 | 4947 |
| 1207334 | 1790 | 1805 | 7178 | 7193 | $A_{ks}G_{ks}{}^mC_{ds}T_{ds}G_{ds}A_{ds}T_{ds}G_{ds}A_{ds}T_{ds}G_{ds}{}^mC_{ks}{}^mC_{es}T_{ks}T_{es}G_k$ | 32 | 3831 |
| 1207342 | 1896 | 1911 | 7284 | 7299 | $G_{ks}A_{ks}G_{ds}T_{ds}{}^mC_{ds}{}^mC_{ds}{}^mC_{ds}T_{ds}G_{ds}A_{ds}G_{ds}T_{es}A_{ks}A_{es}T_{es}T_k$ | 33 | 3834 |
| 1207350 | 1904 | 1919 | 7292 | 7307 | $G_{ks}G_{ks}A_{ds}A_{ds}A_{ds}G_{ds}A_{ds}T_{ds}G_{ds}A_{ds}G_{ds}T_{ks}{}^mC_{es}{}^mC_{ks}{}^mC_{es}T_k$ | 54 | 2921 |
| 1207358 | 1919 | 1934 | 7307 | 7322 | $G_{ks}G_{ks}A_{ds}A_{ds}T_{ds}{}^mC_{ds}A_{ds}{}^mC_{ds}{}^mC_{ds}A_{ds}A_{ds}G_{ks}G_{es}A_{ks}G_{es}G_k$ | 8 | 3226 |
| 1207366 | 1927 | 1942 | 7315 | 7330 | $^mC_{ks}T_{ks}{}^mC_{ds}A_{ds}{}^mC_{ds}T_{ds}G_{ds}{}^mC_{ds}G_{ds}G_{ds}A_{ds}A_{ks}T_{es}{}^mC_{ks}A_{es}{}^mC_k$ | 13 | 3835 |
| 1207374 | 1935 | 1950 | 7323 | 7338 | $G_{ks}{}^mC_{ks}{}^mC_{ds}A_{ds}A_{ds}{}^mC_{ds}T_{ds}{}^mC_{ds}T_{ds}{}^mC_{ds}T_{ds}{}^mC_{ds}A_{ks}{}^mC_{es}T_{ks}G_{es}{}^mC_k$ | 31 | 4967 |
| 1207382 | 2005 | 2020 | 7393 | 7408 | $T_{ks}{}^mC_{ks}{}^mC_{ds}T_{ds}G_{ds}G_{ds}{}^mC_{ds}G_{ds}{}^mC_{ds}{}^mC_{ds}A_{ds}T_{ds}{}^mC_{ks}{}^mC_{es}T_{ks}{}^mC_{es}G_k$ | 27 | 3533 |
| 1207390 | 2013 | 2028 | 7401 | 7416 | $T_{ks}A_{ks}T_{ds}T_{ds}G_{ds}A_{ds}G_{ds}T_{ds}T_{ds}{}^mC_{ds}{}^mC_{ds}T_{ks}G_{es}{}^mC_{ks}G_{es}{}^mC_k$ | 38 | 2617 |

TABLE 82-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207398 | 2022 | 2037 | 7410 | 7425 | $A_{ks}A_{ks}A_{ds}G_{ds}{}^mC_{ds}A_{ds}{}^mC_{ds}T_{ds}T_{ds}A_{ds}T_{ks}T_{es}G_{ks}A_{es}G_k$ | 24 | 3229 |
| 1207406 | 144 | 159 | 511 | 526 | $G_{ks}T_{ks}G_{ks}T_{ds}G_{ds}C_{ds}T_{ds}C_{ds}T_{ds}C_{ds}A_{ds}G_{ks}C_{ks}T_{ks}T_e$ | 6 | 4951 |
| 1207414 | 152 | 167 | N/A | N/A | $G_{ks}A_{ks}A_{ks}{}^mC_{ds}G_{ds}A_{ds}C_{ds}T_{ds}G_{ds}T_{ds}G_{ds}T_{ds}G_{ks}{}^mC_{ks}T_{ks}{}^mC_e$ | 19 | 3647 |
| 1207422 | 209 | 224 | 3560 | 3575 | $G_{ks}G_{ks}T_{ks}A_{ds}{}^mC_{ds}A_{ds}G_{ds}{}^mC_{ds}T_{ds}G_{ds}{}^mC_{ds}{}^mC_{ds}G_{ks}G_{ks}T_{ks}G_e$ | 44 | 4952 |
| 1207430 | 217 | 232 | 3568 | 3583 | $A_{ks}C_{ks}A_{ks}T_{ds}T_{ds}T_{ds}G_{ds}T_{ds}G_{ds}G_{ds}T_{ds}A_{ds}{}^mC_{ks}A_{ks}G_{ks}{}^mC_e$ | 12 | 3114 |
| 1207438 | 1777 | 1792 | 7165 | 7180 | $T_{ks}T_{ks}G_{ks}{}^mC_{ds}A_{ds}G_{ds}G_{ds}G_{ds}T_{ds}G_{ds}A_{ds}G_{ds}T_{ks}T_{ks}G_{ks}G_e$ | 40 | 3375 |
| 1207446 | 1785 | 1800 | 7173 | 7188 | $A_{ks}T_{ks}G_{ks}A_{ds}T_{ds}G_{ds}{}^mC_{ds}{}^mC_{ds}T_{ds}T_{ds}G_{ds}T_{ds}A_{ks}G_{ks}G_{ks}G_e$ | 16 | 3603 |
| 1207454 | 1793 | 1808 | 7181 | 7196 | ${}^mC_{ks}{}^mC_{ks}{}^mC_{ks}A_{ds}G_{ds}{}^mC_{ds}T_{ds}G_{ds}A_{ds}T_{ds}G_{ds}A_{ds}T_{ks}G_{ks}{}^mC_{ks}{}^mC_e$ | 11 | 4953 |
| 1207462 | 1899 | 1914 | 7287 | 7302 | $G_{ks}A_{ks}T_{ks}G_{ds}A_{ds}G_{ds}T_{ds}{}^mC_{ds}{}^mC_{ds}{}^mC_{ds}T_{ds}G_{ds}A_{ks}G_{ks}{}^mC_{ks}A_e$ | 15 | 2537 |
| 1207470 | 1914 | 1929 | 7302 | 7317 | $C_{ks}A_{ks}C_{ks}C_{ds}A_{ds}A_{ds}G_{ds}G_{ds}A_{ds}G_{ds}G_{ds}G_{ds}A_{ks}A_{ks}A_{ks}G_e$ | 40 | 4954 |
| 1207478 | 1922 | 1937 | 7310 | 7325 | $T_{ks}G_{ks}{}^mC_{ks}G_{ds}G_{ds}A_{ds}A_{ds}T_{ds}{}^mC_{ds}A_{ds}{}^mC_{ds}C_{ds}A_{ks}A_{ks}G_{ks}G_e$ | 16 | 3455 |
| 1207486 | 1930 | 1945 | 7318 | 7333 | $T_{ks}{}^mC_{ks}T_{ks}{}^mC_{ds}T_{ds}{}^mC_{ds}A_{ds}{}^mC_{ds}T_{ds}{}^mG_{ds}C_{ds}G_{ds}G_{ks}A_{ks}A_{ks}T_e$ | 22 | 4955 |
| 1207494 | 2000 | 2015 | 7388 | 7403 | ${}^mC_{ks}G_{ks}{}^mC_{ks}{}^mC_{ds}A_{ds}T_{ds}{}^mC_{ds}{}^mC_{ds}T_{ds}G_{ds}G_{ds}{}^mC_{ds}G_{ks}T_{ks}G_{ks}G_e$ | 39 | 3228 |
| 1207502 | 2008 | 2023 | 7396 | 7411 | $A_{ks}G_{ks}T_{ks}T_{ds}{}^mC_{ds}{}^mC_{ds}T_{ds}G_{ds}{}^mC_{ds}G_{ds}{}^mC_{ds}{}^mC_{ds}A_{ks}T_{ks}{}^mC_{ks}{}^mC_e$ | 22 | 3761 |
| 1207518 | 2031 | 2046 | 7419 | 7434 | $A_{ks}G_{ks}{}^mC_{ks}A_{ds}T_{ds}T_{ds}T_{ds}T_{ds}{}^mC_{ds}AA_{dsds}A_{ds}G_{ks}{}^mC_{ks}A_{ks}{}^mC_e$ | 13 | 3458 |

TABLE 83

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1129531 | 2009 | 2024 | 7397 | 7412 | $G_{ks}A_{ks}G_{ks}T_{ds}T_{ds}{}^mC_{ds}{}^mC_{ds}T_{ds}G_{ds}{}^mC_{ds}G_{ds}C_{ds}C_{ds}A_{ks}T_{ks}C_k$ | 8 | 3837 |
| 1206488 | 1930 | 1945 | 7318 | 7333 | $T_{ks}{}^mC_{ks}T_{ks}{}^mC_{ds}T_{ds}{}^mC_{ds}A_{ds}{}^mC_{ds}T_{d s}G_{ds}{}^mC_{ds}G_{ds}G_{ds}A_{ks}A_{ks}T_k$ | 10 | 4955 |
| 1206497 | 211 | 226 | 3562 | 3577 | $G_{ks}T_{ks}G_{ks}G_{ds}T_{ds}A_{ds}{}^mC_{ds}A_{ds}G_{ds}{}^mC_{ds}T_{ds}G_{ds}{}^mC_{ds}{}^mC_{ks}G_{ks}G_k$ | 7 | 4973 |
| 1206503 | 1792 | 1807 | 7180 | 7195 | ${}^mC_{ks}{}^mC_{ks}A_{ks}G_{ds}{}^mC_{ds}T_{ds}G_{ds}A_{ds}T_{ds}G_{ds}A_{ds}T_{ds}G_{ds}C_{ks}C_{ks}T_k$ | 35 | 4970 |

TABLE 83-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1206898 | 141 | 156 | 508 | 523 | $T_{ks}G_{es}C_{ks}T_{ds}C_{ds}T_{ds}T_{ds}C_{ds}A_{ds}G_{ds}{}^mC_{ds}T_{ds}T_{es}T_{es}G_{ks}T_k$ | 18 | 4950 |
| 1206906 | 149 | 164 | 516 | 531 | ${}^mC_{ks}G_{es}A_{ks}{}^mC_{ds}T_{ds}G_{ds}T_{ds}G_{ds}T_{ds}G_{ds}{}^mC_{ds}T_{ds}{}^mC_{es}T_{es}G_{ks}T_k$ | 5 | 3419 |
| 1206914 | 157 | 172 | N/A | N/A | $A_{ks}G_{es}T_{ks}G_{ds}A_{ds}G_{ds}A_{ds}A_{ds}C_{ds}G_{ds}A_{ds}{}^mC_{ds}T_{es}G_{es}T_{ks}G_k$ | 14 | 2502 |
| 1206922 | 214 | 229 | 3565 | 3580 | $T_{ks}T_{es}T_{ks}G_{ds}T_{ds}G_{ds}G_{ds}T_{ds}A_{ds}{}^mC_{ds}A_{ds}G_{ds}{}^mC_{es}T_{es}G_{ks}{}^mC_k$ | 22 | 2887 |
| 1206930 | 222 | 237 | 3573 | 3588 | $T_{ks}G_{es}G_{ks}G_{ds}T_{ds}A_{ds}{}^mC_{ds}A_{ds}T_{ds}T_{ds}T_{ds}G_{ds}T_{es}G_{es}G_{ks}T_k$ | 11 | 3421 |
| 1206938 | 1782 | 1797 | 7170 | 7185 | $A_{ks}T_{es}G_{ks}{}^mC_{ds}{}^mC_{ds}T_{ds}T_{ds}G_{ds}{}^mC_{ds}A_{ds}G_{ds}G_{es}T_{es}G_{ks}A_k$ | 27 | 4947 |
| 1206946 | 1790 | 1805 | 7178 | 7193 | $A_{ks}G_{es}{}^mC_{ks}T_{ds}G_{ds}A_{ds}T_{ds}G_{ds}A_{ds}T_{ds}G_{ds}{}^mC_{ds}{}^mC_{es}T_{es}T_{ks}G_k$ | 32 | 3831 |
| 1206954 | 1896 | 1911 | 7284 | 7299 | $G_{ks}A_{es}G_{ks}T_{ds}{}^mC_{ds}{}^mC_{ds}{}^mC_{ds}T_{ds}G_{ds}A_{ds}G_{ds}{}^mC_{ds}A_{es}A_{es}T_{ks}{}^mC_k$ | 16 | 3834 |
| 1206962 | 1904 | 1919 | 7292 | 7307 | $G_{ks}G_{es}A_{ks}A_{ds}A_{ds}G_{ds}A_{ds}T_{ds}G_{ds}A_{ds}G_{ds}T_{ds}{}^mC_{es}{}^mC_{es}{}^mC_{ks}T_k$ | 16 | 2921 |
| 1206970 | 1919 | 1934 | 7307 | 7322 | $G_{ks}G_{es}A_{ks}A_{ds}T_{ds}C_{ds}A_{ds}C_{ds}C_{ds}A_{ds}A_{ds}G_{ds}G_{es}A_{es}G_{ks}G_k$ | 7 | 3226 |
| 1206978 | 1927 | 1942 | 7315 | 7330 | ${}^mC_{ks}T_{es}{}^mC_{ks}A_{ds}{}^mC_{ds}T_{ds}G_{ds}G_{ds}{}^mC_{ds}G_{ds}G_{ds}A_{ds}A_{ds}T_{es}{}^mC_{es}A_{ks}{}^mC_k$ | 7 | 3835 |
| 1206986 | 1935 | 1950 | 7323 | 7338 | $G_{ks}{}^mC_{es}{}^mC_{ks}A_{ds}{}^mC_{ds}T_{ds}{}^mC_{ds}T_{ds}{}^mC_{ds}T_{ds}{}^mC_{ds}{}^mC_{ds}A_{ds}{}^mC_{es}T_{es}G_{ks}{}^mC_k$ | 8 | 4967 |
| 1206994 | 2005 | 2020 | 7393 | 7408 | $T_{ks}{}^mC_{es}{}^mC_{ks}T_{ds}G_{ds}{}^mC_{ds}G_{ds}{}^mC_{ds}{}^mC_{ds}A_{ds}T_{ds}C_{ds}C_{es}T_{es}G_{ks}G_k$ | 10 | 3533 |
| 1207002 | 2013 | 2028 | 7401 | 7416 | $T_{ks}A_{es}T_{ks}T_{ds}G_{ds}A_{ds}G_{ds}T_{ds}T_{ds}{}^mC_{ds}{}^mC_{ds}T_{ds}G_{es}{}^mC_{es}G_{ks}{}^mC_k$ | 19 | 2617 |
| 1207010 | 2022 | 2037 | 7410 | 7425 | $A_{ks}A_{es}A_{ks}G_{ds}{}^mC_{ds}A_{ds}{}^mC_{ds}T_{ds}T_{ds}T_{ds}A_{ds}T_{ds}T_{es}G_{es}A_{ks}G_k$ | 3 | 3229 |
| 1207029 | 144 | 159 | 511 | 526 | $G_{ks}T_{es}G_{ds}T_{ds}G_{ds}G_{ds}{}^mC_{ds}T_{ds}T_{ds}{}^mC_{ds}T_{ds}T_{ds}{}^mC_{ds}A_{es}G_{es}{}^mC_{es}T_{ks}T_k$ | 11 | 4951 |
| 1207037 | 152 | 167 | N/A | N/A | $G_{ks}A_{ks}A_{ds}{}^mC_{ds}G_{ds}A_{ds}{}^mC_{ds}T_{ds}G_{ds}T_{ds}G_{ds}T_{es}G_{es}{}^mC_{es}T_{ks}{}^mC_k$ | 14 | 3647 |
| 1207045 | 209 | 224 | 3560 | 3575 | $G_{ks}G_{ks}T_{ds}A_{ds}{}^mC_{ds}A_{ds}G_{ds}{}^mC_{ds}T_{ds}G_{ds}{}^mC_{ds}T_{es}G_{es}G_{es}T_{ks}G_k$ | 5 | 4952 |
| 1207053 | 217 | 232 | 3568 | 3583 | $A_{ks}C_{ks}A_{ds}T_{ds}T_{ds}T_{ds}G_{ds}T_{ds}G_{ds}G_{ds}T_{ds}A_{es}{}^mC_{es}A_{es}G_{ks}{}^mC_k$ | 12 | 3114 |
| 1207061 | 1777 | 1792 | 7165 | 7180 | $T_{ks}T_{ks}G_{ds}{}^mC_{ds}A_{ds}G_{ds}G_{ds}G_{ds}T_{ds}G_{ds}A_{ds}G_{es}{}^mC_{es}{}^mC_{es}G_{ks}G_k$ | 20 | 3375 |
| 1207082 | 1785 | 1800 | 7173 | 7188 | $A_{ks}T_{ks}G_{ds}A_{ds}T_{ds}G_{ds}{}^mC_{ds}T_{ds}{}^mC_{ds}T_{ds}T_{ds}G_{ds}C_{es}A_{es}G_{es}G_{ks}G_k$ | 15 | 3603 |
| 1207090 | 1793 | 1808 | 7181 | 7196 | ${}^mC_{ks}{}^mC_{ks}{}^mC_{ds}A_{ds}G_{ds}{}^mC_{ds}T_{ds}G_{ds}A_{ds}T_{ds}G_{ds}A_{es}T_{es}G_{es}{}^mC_{ks}{}^mC_k$ | 52 | 4953 |
| 1207098 | 1899 | 1914 | 7287 | 7302 | $G_{ks}A_{ks}T_{ds}G_{ds}A_{ds}G_{ds}T_{ds}{}^mC_{ds}{}^mC_{ds}{}^mC_{ds}T_{ds}G_{es}A_{es}G_{es}{}^mC_{ks}A_k$ | 12 | 2537 |
| 1207106 | 1914 | 1929 | 7302 | 7317 | ${}^mC_{ks}A_{ks}{}^mC_{ds}{}^mC_{ds}A_{ds}A_{ds}G_{ds}G_{ds}A_{ds}G_{ds}G_{ds}G_{es}A_{es}A_{es}A_{ks}G_k$ | 13 | 4954 |

TABLE 83-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207114 | 1922 | 1937 | 7310 | 7325 | $T_{ks}G_{ks}C_{ds}G_{ds}G_{ds}A_{ds}A_{ds}T_{ds}C_{ds}A_{ds}{}^mC_{ds}{}^mC_{es}A_{es}A_{es}G_{ks}G_k$ | 11 | 3455 |
| 1207127 | 1930 | 1945 | 7318 | 7333 | $T_{ks}{}^mC_{ks}T_{ds}{}^mC_{ds}{}^mC_{ds}A_{ds}{}^mC_{ds}T_{ds}G_{ds}{}^mC_{ds}G_{es}G_{es}A_{es}A_{ks}T_k$ | 12 | 4955 |
| 1207142 | 2000 | 2015 | 7388 | 7403 | ${}^mC_{ks}G_{ks}{}^mC_{ds}{}^mC_{ds}A_{ds}T_{ds}{}^mC_{ds}{}^mC_{ds}T_{ds}G_{ds}G_{ds}{}^mC_{es}G_{es}{}^mC_{es}G_{ks}G_k$ | 24 | 3228 |
| 1207151 | 2008 | 2023 | 7396 | 7411 | $A_{ks}G_{ks}T_{ds}T_{ds}{}^mC_{ds}{}^mC_{ds}T_{ds}G_{ds}{}^mC_{ds}G_{ds}{}^mC_{ds}{}^mC_{es}A_{es}T_{es}{}^mC_{ks}{}^mC_k$ | 19 | 3761 |
| 1207159 | 2017 | 2032 | 7405 | 7420 | $A_{ks}{}^mC_{ks}T_{ds}T_{ds}T_{ds}A_{ds}T_{ds}T_{ds}G_{ds}A_{ds}G_{ds}T_{es}T_{es}C_{es}C_{ks}T_k$ | 4 | 2848 |
| 1207167 | 2031 | 2046 | 7419 | 7434 | $A_{ks}G_{ks}C_{ds}A_{ds}T_{ds}T_{ds}T_{ds}T_{ds}C_{ds}A_{ds}A_{ds}A_{es}G_{es}C_{es}A_{ks}C_k$ | 20 | 3458 |
| 1207175 | 147 | 162 | 514 | 529 | $A_{ks}{}^mC_{ks}T_{ds}G_{ds}T_{ds}G_{ds}T_{ds}G_{ds}{}^mC_{ds}T_{ds}{}^mC_{ds}T_{es}T_{ks}{}^mC_{es}A_{ks}G_e$ | 13 | 3267 |
| 1207183 | 155 | 170 | N/A | N/A | $T_{ks}G_{ks}A_{ds}G_{ds}A_{ds}A_{ds}C_{ds}G_{ds}A_{ds}C_{ds}T_{ds}G_{es}T_{ks}G_{es}T_{ks}G_e$ | 26 | 3875 |
| 1207191 | 212 | 227 | 3563 | 3578 | $T_{ks}G_{ks}T_{ds}G_{ds}G_{ds}T_{ds}A_{ds}C_{ds}A_{ds}G_{ds}C_{ds}T_{es}G_{ks}{}^mC_{es}{}^mC_{ks}G_e$ | 11 | 2734 |
| 1207199 | 220 | 235 | 3571 | 3586 | $G_{ks}G_{ks}T_{ds}A_{ds}{}^mC_{ds}A_{ds}T_{ds}T_{ds}T_{ds}G_{ds}T_{ds}G_{es}G_{ks}T_{es}A_{ks}{}^mC_e$ | 14 | 3269 |
| 1207207 | 1780 | 1795 | 7168 | 7183 | $G_{ks}{}^mC_{ks}{}^mC_{ds}T_{ds}T_{ds}G_{ds}{}^mC_{ds}A_{ds}G_{ds}G_{ds}G_{ds}T_{es}G_{ks}A_{es}G_{ks}C_e$ | 22 | 3451 |
| 1207215 | 1788 | 1803 | 7176 | 7191 | ${}^mC_{ks}T_{ks}G_{ds}A_{ds}T_{ds}G_{ds}A_{ds}T_{ds}G_{ds}{}^mC_{ds}{}^mC_{ds}T_{es}T_{ks}G_{es}{}^mC_{ks}A_e$ | 12 | 3679 |
| 1207223 | 1894 | 1909 | 7282 | 7297 | $G_{ks}T_{ks}{}^mC_{ds}{}^mC_{ds}{}^mC_{ds}T_{ds}G_{ds}A_{ds}A_{ds}G_{ds}{}^mC_{ds}A_{es}T_{ks}{}^mC_{es}A_{ks}G_e$ | 27 | 3682 |
| 1207231 | 1902 | 1917 | 7290 | 7305 | $A_{ks}A_{ks}A_{ds}G_{ds}A_{ds}T_{ds}G_{ds}A_{ds}G_{ds}T_{ds}C_{ds}{}^mC_{es}{}^mC_{ks}T_{es}G_{ks}A_e$ | 19 | 2768 |
| 1207239 | 1917 | 1932 | 7305 | 7320 | $A_{ks}A_{ks}T_{ds}C_{ds}A_{ds}C_{ds}C_{ds}A_{ds}A_{ds}G_{ds}G_{ds}A_{es}G_{ks}G_{es}G_{ks}A_e$ | 14 | 4956 |
| 1207247 | 1925 | 1940 | 7313 | 7328 | ${}^mC_{ks}A_{ks}{}^mC_{ds}T_{ds}G_{ds}{}^mC_{ds}G_{ds}G_{ds}A_{ds}A_{ds}T_{ds}{}^mC_{es}A_{ks}{}^mC_{es}{}^mC_{ks}A_e$ | 11 | 3683 |
| 1207255 | 1933 | 1948 | 7321 | 7336 | ${}^mC_{ks}A_{ks}{}^mC_{ds}T_{ds}{}^mC_{ds}T_{ds}{}^mC_{ds}T_{ds}{}^mC_{ds}A_{ds}{}^mC_{ds}T_{es}G_{ks}{}^mC_{es}G_{ks}G_e$ | N.D. | 4957 |
| 1207263 | 2003 | 2018 | 7391 | 7406 | ${}^mC_{ks}T_{ks}G_{ds}{}^mC_{ds}G_{ds}{}^mC_{ds}{}^mC_{ds}A_{ds}T_{ds}{}^mC_{ds}{}^mC_{ds}T_{es}G_{ks}G_{es}{}^mC_{ks}G_e$ | 30 | 3381 |
| 1207271 | 2011 | 2026 | 7399 | 7414 | $T_{ks}T_{ks}G_{ds}A_{ds}G_{ds}T_{ds}T_{ds}C_{ds}C_{ds}T_{ds}G_{ds}{}^mC_{es}G_{ks}{}^mC_{es}{}^mC_{ks}A_e$ | 9 | 2463 |
| 1207279 | 2020 | 2035 | 7408 | 7423 | $A_{ks}G_{ks}{}^mC_{ds}A_{ds}{}^mC_{ds}T_{ds}T_{ds}T_{ds}A_{ds}T_{ds}T_{ds}G_{es}A_{ks}G_{es}T_{ks}T_e$ | 6 | 3076 |
| 1207287 | 142 | 157 | 509 | 524 | $G_{ks}T_{ks}G_{ds}{}^mC_{ds}T_{ds}{}^mC_{ds}T_{ds}T_{ds}{}^mC_{ds}A_{ds}G_{ds}{}^mC_{ks}T_{es}T_{ks}T_{es}G_k$ | 15 | 4958 |
| 1207295 | 150 | 165 | N/A | N/A | $A_{ks}{}^mC_{ks}G_{ds}A_{ds}{}^mC_{ds}T_{ds}G_{ds}T_{ds}G_{ds}T_{ds}G_{ds}{}^mC_{ks}T_{es}{}^mC_{ks}T_{es}T_k$ | 13 | 3495 |
| 1207303 | 158 | 173 | N/A | N/A | ${}^mC_{ks}A_{ks}G_{ds}T_{ds}G_{ds}A_{ds}G_{ds}A_{ds}A_{ds}{}^mC_{ds}G_{ds}A_{ks}{}^mC_{es}T_{ks}G_{es}T_k$ | 31 | 2579 |
| 1207311 | 215 | 230 | 3566 | 3581 | $A_{ks}T_{ks}T_{ds}T_{ds}G_{ds}T_{ds}G_{ds}G_{ds}T_{ds}A_{ds}{}^mC_{ds}A_{ks}G_{es}{}^mC_{ks}T_{es}G_k$ | 30 | 2963 |

TABLE 83-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207319 | 223 | 238 | 3574 | 3589 | $G_{ks}T_{ks}G_{ds}G_{ds}G_{ds}T_{ds}A_{ds}C_{ds}A_{ds}T_{ds}T_{ds}T_{ks}G_{es}T_{ks}G_{es}G_{k}$ | 19 | 3497 |
| 1207327 | 1783 | 1798 | 7171 | 7186 | $G_{ks}A_{ks}T_{ds}G_{ds}{}^mC_{ds}{}^mC_{ds}T_{ds}T_{ds}G_{ds}{}^mC_{ds}A_{ds}G_{ks}G_{es}G_{ks}T_{es}G_{k}$ | 66 | 4959 |
| 1207335 | 1791 | 1806 | 7179 | 7194 | ${}^mC_{ks}A_{ks}G_{ds}{}^mC_{ds}T_{ds}G_{ds}A_{ds}T_{ds}G_{ds}A_{ds}T_{ds}G_{ks}C_{es}C_{ks}T_{es}T_{k}$ | 24 | 4960 |
| 1207343 | 1897 | 1912 | 7285 | 7300 | $T_{ks}G_{ks}A_{ds}G_{ds}T_{ds}C_{ds}C_{ds}C_{ds}T_{ds}G_{ds}A_{ds}G_{ks}{}^mC_{es}A_{ks}A_{es}T_{k}$ | 20 | 3910 |
| 1207351 | 1905 | 1920 | 7293 | 7308 | $G_{ks}G_{ks}G_{ds}A_{ds}A_{ds}A_{ds}G_{ds}A_{ds}T_{ds}G_{ds}A_{ds}G_{ks}T_{es}{}^mC_{ks}{}^mC_{es}{}^mC_{k}$ | 10 | 2997 |
| 1207359 | 1920 | 1935 | 7308 | 7323 | ${}^mC_{ks}G_{ks}G_{ds}A_{ds}A_{ds}T_{ds}{}^mC_{ds}A_{ds}{}^mC_{ds}{}^mC_{ds}A_{ds}A_{ks}G_{es}G_{ks}A_{es}G_{k}$ | 18 | 3303 |
| 1207367 | 1928 | 1943 | 7316 | 7331 | $T_{ks}{}^mC_{ks}T_{ds}{}^mC_{ds}A_{ds}{}^mC_{ds}T_{ds}G_{ds}{}^mC_{ds}G_{ds}G_{ds}A_{ks}A_{es}T_{ks}C_{es}A_{k}$ | 4 | 3911 |
| 1207375 | 1936 | 1951 | 7324 | 7339 | $A_{ks}G_{ks}{}^mC_{ds}{}^mC_{ds}A_{ds}{}^mC_{ds}T_{ds}{}^mC_{ds}T_{ds}{}^mC_{ds}T_{ds}{}^mC_{ks}A_{es}{}^mC_{ks}T_{es}G_{k}$ | 10 | 4961 |
| 1207383 | 2006 | 2021 | 7394 | 7409 | $T_{ks}T_{ks}T_{ds}C_{ds}T_{ds}G_{ds}C_{ds}G_{ds}C_{ds}C_{ds}A_{ds}T_{ks}C_{es}C_{ks}T_{es}G_{k}$ | 20 | 3609 |
| 1207391 | 2014 | 2029 | 7402 | 7417 | $T_{ks}T_{ks}A_{ds}T_{ds}G_{ds}A_{ds}G_{ds}T_{ds}T_{ds}C_{ds}{}^mC_{ks}T_{es}G_{ks}{}^mC_{es}G_{k}$ | 28 | 2694 |
| 1207399 | 2023 | 2038 | 7411 | 7426 | ${}^mC_{ks}A_{ks}A_{ds}A_{ds}G_{ds}{}^mC_{ds}A_{ds}{}^mC_{ds}T_{ds}T_{ds}T_{ds}A_{ks}T_{es}T_{ks}G_{es}A_{k}$ | 13 | 3306 |
| 1207407 | 145 | 160 | 512 | 527 | $T_{ks}G_{ks}T_{ks}G_{ds}T_{ds}G_{ds}C_{ds}T_{ds}C_{ds}T_{ds}T_{ds}T_{ds}A_{ks}G_{ks}{}^mC_{ks}T_{e}$ | 6 | 3112 |
| 1207415 | 153 | 168 | N/A | N/A | $A_{ks}G_{ks}A_{ks}A_{ds}{}^mC_{ds}G_{ds}A_{ds}{}^mC_{ds}T_{ds}G_{ds}T_{ds}G_{ds}T_{ks}G_{ks}{}^mC_{ks}T_{e}$ | 19 | 3723 |
| 1207423 | 210 | 225 | 3561 | 3576 | $T_{ks}G_{ks}G_{ks}T_{ds}A_{ds}{}^mC_{ds}A_{ds}G_{ds}{}^mC_{ds}T_{ds}G_{ds}{}^mC_{ds}{}^mC_{ks}G_{ks}G_{ks}T_{e}$ | 23 | 2657 |
| 1207431 | 218 | 233 | 3569 | 3584 | $T_{ks}A_{ks}{}^mC_{ks}A_{ds}T_{ds}T_{ds}T_{ds}G_{ds}T_{ds}G_{ds}G_{ds}T_{ds}A_{ks}{}^mC_{ks}A_{ks}G_{e}$ | 18 | 2426 |
| 1207439 | 1778 | 1793 | 7166 | 7181 | ${}^mC_{ks}T_{ks}T_{ks}G_{ds}{}^mC_{ds}A_{ds}G_{ds}G_{ds}G_{ds}T_{ds}G_{ds}A_{ds}G_{ks}{}^mC_{ks}{}^mC_{ks}G_{e}$ | 26 | 4962 |
| 1207447 | 1786 | 1801 | 7174 | 7189 | $G_{ks}A_{ks}T_{ks}G_{ds}A_{ds}T_{ds}G_{ds}{}^mC_{ds}{}^mC_{ds}T_{ds}T_{ds}G_{ds}{}^mC_{ks}A_{ks}G_{ks}G_{e}$ | 7 | 4963 |
| 1207455 | 1892 | 1907 | 7280 | 7295 | ${}^mC_{ks}{}^mC_{ks}{}^mC_{ks}T_{ds}G_{ds}A_{ds}G_{ds}{}^mC_{ds}A_{ds}A_{ds}T_{ds}{}^mC_{ds}A_{ks}G_{ks}G_{ks}A_{e}$ | 18 | 3530 |
| 1207463 | 1900 | 1915 | 7288 | 7303 | $A_{ks}G_{ks}A_{ks}T_{ds}G_{ds}A_{ds}G_{ds}T_{ds}{}^mC_{ds}{}^mC_{ds}{}^mC_{ds}T_{ds}G_{ks}A_{ks}G_{ks}{}^mC_{e}$ | 14 | 2614 |
| 1207471 | 1915 | 1930 | 7303 | 7318 | $T_{ks}{}^mC_{ks}A_{ks}{}^mC_{ds}{}^mC_{ds}A_{ds}A_{ds}G_{ds}G_{ds}A_{ds}G_{ds}G_{ds}G_{ks}A_{ks}A_{ks}A_{e}$ | 24 | 4948 |
| 1207479 | 1923 | 1938 | 7311 | 7326 | ${}^mC_{ks}T_{ks}G_{ks}{}^mC_{ds}G_{ds}G_{ds}A_{ds}T_{ds}{}^mC_{ds}A_{ds}{}^mC_{ds}{}^mC_{ks}A_{ks}A_{ks}G_{e}$ | 11 | 3531 |
| 1207487 | 1931 | 1946 | 7319 | 7334 | ${}^mC_{ks}T_{ks}{}^mC_{ks}T_{ds}{}^mC_{ds}T_{ds}{}^mC_{ds}A_{ds}{}^mC_{ds}T_{ds}G_{ds}{}^mC_{ds}G_{ks}G_{ks}A_{ks}A_{e}$ | 6 | 2461 |
| 1207495 | 2001 | 2016 | 7389 | 7404 | $G_{ks}{}^mC_{ks}G_{ks}{}^mC_{ds}{}^mC_{ds}A_{ds}T_{ds}{}^mC_{ds}{}^mC_{ds}T_{ds}G_{ds}G_{ds}{}^mC_{ks}G_{ks}{}^mC_{ks}G_{e}$ | 116 | 4964 |
| 1207503 | 2009 | 2024 | 7397 | 7412 | $G_{ks}A_{ks}G_{ks}T_{ds}T_{ds}{}^mC_{ds}{}^mC_{ds}T_{ds}G_{ds}{}^mC_{ds}G_{ds}{}^mC_{ds}{}^mC_{ks}A_{ks}T_{ks}{}^mC_{e}$ | 9 | 3837 |

TABLE 83-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207511 | 2018 | 2033 | 7406 | 7421 | $^mC_{ks}A_{ks}{}^mC_{ks}T_{ds}T_{ds}T_{ds}A_{ds}T_{ds}T_{ds}G_{ds}A_{ds}G_{ds}T_{ks}T_{ks}{}^mC_{ks}{}^mC_e$ | 11 | 2924 |
| 1207519 | 2033 | 2048 | 7421 | 7436 | $T_{ks}{}^mC_{ks}A_{ks}G_{ds}{}^mC_{ds}A_{ds}T_{ds}T_{ds}T_{ds}{}^mC_{ds}A_{ds}A_{ks}A_{ks}G_{ks}{}^mC_e$ | 20 | 3534 |

TABLE 84

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1129491 | 1927 | 1942 | 7315 | 7330 | $^mC_{ks}T_{ks}{}^mC_{ks}A_{ds}{}^mC_{ds}T_{ds}G_{ds}{}^mC_{ds}G_{ds}G_{ds}A_{ds}A_{ds}T_{ds}{}^mC_{ks}A_{ks}{}^mC_k$ | 14 | 3835 |
| 1129531 | 2009 | 2024 | 7397 | 7412 | $G_{ks}A_{ks}G_{ds}T_{ds}T_{ds}{}^mC_{ds}{}^mC_{ds}T_{ds}G_{ds}{}^mC_{ds}G_{ds}{}^mC_{ds}{}^mC_{ds}A_{ks}T_{ks}{}^mC_k$ | 7 | 3837 |
| 1206489 | 1932 | 1947 | 7320 | 7335 | $A_{ks}{}^mC_{ks}T_{ks}{}^mC_{ds}T_{ds}{}^mC_{ds}T_{ds}{}^mC_{ds}A_{ds}{}^mC_{ds}T_{ds}G_{ds}{}^mC_{ds}G_{ks}G_{ks}A_k$ | 5 | 4976 |
| 1206498 | 1778 | 1793 | 7166 | 7181 | $^mC_{ks}T_{ks}T_{ks}G_{ds}{}^mC_{ds}A_{ds}G_{ds}G_{ds}G_{ds}T_{ds}G_{ds}A_{ds}G_{ds}{}^mC_{ks}{}^mC_{ks}G_k$ | 24 | 4962 |
| 1206504 | 1793 | 1808 | 7181 | 7196 | $^mC_{ks}{}^mC_{ks}{}^mC_{ks}A_{ds}G_{ds}{}^mC_{ds}T_{ds}G_{ds}A_{ds}T_{ds}G_{ds}A_{ds}T_{ds}G_{ks}{}^mC_{ks}{}^mC_k$ | 29 | 4953 |
| 1206899 | 142 | 157 | 509 | 524 | $G_{ks}T_{es}G_{ks}{}^mC_{ds}T_{ds}{}^mC_{ds}T_{ds}T_{ds}{}^mC_{ds}A_{ds}G_{ds}{}^mC_{ds}T_{es}T_{es}T_{ks}G_k$ | 8 | 4958 |
| 1206907 | 150 | 165 | N/A | N/A | $A_{ks}{}^mC_{es}G_{ks}A_{ds}{}^mC_{ds}T_{ds}G_{ds}T_{ds}G_{ds}T_{ds}G_{ds}{}^mC_{ds}T_{es}{}^mC_{es}T_{ks}T_k$ | 20 | 3495 |
| 1206915 | 158 | 173 | N/A | N/A | $^mC_{ks}A_{es}G_{ks}T_{ds}G_{ds}A_{ds}G_{ds}A_{ds}A_{ds}{}^mC_{ds}G_{ds}A_{ds}{}^mC_{es}T_{es}G_{ks}T_k$ | 25 | 2579 |
| 1206923 | 215 | 230 | 3566 | 3581 | $A_{ks}T_{es}T_{ks}T_{ds}G_{ds}T_{ds}G_{ds}G_{ds}T_{ds}A_{ds}{}^mC_{ds}A_{ds}{}^mC_{es}{}^mC_{es}T_{ks}G_k$ | 23 | 2963 |
| 1206931 | 223 | 238 | 3574 | 3589 | $G_{ks}T_{es}G_{ks}G_{ds}G_{ds}T_{ds}A_{ds}{}^mC_{ds}A_{ds}T_{ds}T_{ds}T_{ds}G_{es}T_{es}G_{ks}G_k$ | 23 | 3497 |
| 1206939 | 1783 | 1798 | 7171 | 7186 | $G_{ks}A_{es}T_{ks}G_{ds}{}^mC_{ds}{}^mC_{ds}T_{ds}T_{ds}G_{ds}{}^mC_{ds}A_{ds}G_{ds}G_{es}G_{es}T_{ks}G_k$ | 32 | 4959 |
| 1206947 | 1791 | 1806 | 7179 | 7194 | $^mC_{ks}A_{es}G_{ks}{}^mC_{ds}T_{ds}G_{ds}A_{ds}T_{ds}G_{ds}A_{ds}T_{ds}G_{ds}{}^mC_{es}{}^mC_{es}T_{ks}T_k$ | 41 | 4960 |
| 1206955 | 1897 | 1912 | 7285 | 7300 | $T_{ks}G_{es}A_{ks}G_{ds}T_{ds}{}^mC_{ds}{}^mC_{ds}{}^mC_{ds}T_{ds}G_{ds}A_{ds}G_{ds}{}^mC_{es}A_{es}A_{ks}T_k$ | 25 | 3910 |
| 1206963 | 1905 | 1920 | 7293 | 7308 | $G_{ks}G_{es}G_{ks}A_{ds}A_{ds}A_{ds}G_{ds}T_{ds}T_{ds}G_{ds}A_{ds}G_{ds}T_{es}{}^mC_{es}{}^mC_{ks}{}^mC_k$ | 43 | 2997 |
| 1206971 | 1920 | 1935 | 7308 | 7323 | $^mC_{ks}G_{es}G_{ks}A_{ds}A_{ds}T_{ds}{}^mC_{ds}A_{ds}{}^mC_{ds}{}^mC_{ds}A_{ds}A_{ds}G_{es}G_{es}A_{ks}G_k$ | 7 | 3303 |
| 1206979 | 1928 | 1943 | 7316 | 7331 | $T_{ks}{}^mC_{es}T_{ks}{}^mC_{ds}A_{ds}{}^mC_{ds}T_{ds}G_{ds}{}^mC_{ds}G_{ds}G_{ds}A_{ds}A_{es}T_{es}{}^mC_{ks}A_k$ | 15 | 3911 |
| 1206987 | 1936 | 1951 | 7324 | 7339 | $A_{ks}G_{es}{}^mC_{ks}{}^mC_{ds}A_{ds}{}^mC_{ds}T_{ds}{}^mC_{ds}T_{ds}{}^mC_{ds}T_{ds}{}^mC_{ds}A_{es}{}^mC_{es}T_{ks}G_k$ | 8 | 4961 |

TABLE 84-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1206995 | 2006 | 2021 | 7394 | 7409 | $T_{ks}T_{es}{}^mC_{ks}{}^mC_{ds}T_{ds}G_{ds}{}^mC_{ds}G_{ds}{}^mC_{ds}{}^mC_{ds}A_{ds}T_{ds}{}^mC_{es}{}^mC_{es}T_{ks}G_k$ | 30 | 3609 |
| 1207003 | 2014 | 2029 | 7402 | 7417 | $T_{ks}T_{es}A_{ks}T_{ds}T_{ds}G_{ds}A_{ds}G_{ds}T_{ds}T_{ds}{}^mC_{ds}{}^mC_{ds}T_{es}G_{es}{}^mC_{ks}G_k$ | 16 | 2694 |
| 1207011 | 2023 | 2038 | 7411 | 7426 | ${}^mC_{ks}A_{es}A_{ks}A_{ds}G_{ds}{}^mC_{ds}A_{ds}{}^mC_{ds}T_{ds}T_{ds}T_{ds}A_{ds}T_{es}T_{es}G_{ks}A_k$ | 25 | 3306 |
| 1207030 | 145 | 160 | 512 | 527 | $T_{ks}G_{ks}T_{ds}G_{ds}T_{ds}G_{ds}{}^mC_{ds}T_{ds}{}^mC_{ds}T_{ds}T_{ds}{}^mC_{es}A_{es}G_{es}{}^mC_{ks}T_k$ | 7 | 3112 |
| 1207038 | 153 | 168 | N/A | N/A | $A_{ks}G_{ks}A_{ds}A_{ds}{}^mC_{ds}G_{ds}A_{ds}{}^mC_{ds}T_{ds}G_{ds}T_{ds}G_{es}T_{es}G_{es}{}^mC_{ks}T_k$ | 15 | 3723 |
| 1207046 | 210 | 225 | 3561 | 3576 | $T_{ks}G_{ks}G_{ds}T_{ds}A_{ds}{}^mC_{ds}A_{ds}G_{ds}{}^mC_{ds}T_{ds}G_{ds}{}^mC_{es}{}^mC_{es}G_{es}G_{ks}T_k$ | 18 | 2657 |
| 1207054 | 218 | 233 | 3569 | 3584 | $T_{ks}A_{ks}{}^mC_{ds}A_{ds}T_{ds}T_{ds}T_{ds}G_{ds}T_{ds}G_{ds}G_{ds}T_{es}A_{es}{}^mC_{es}A_{ks}G_k$ | 27 | 2426 |
| 1207062 | 1778 | 1793 | 7166 | 7181 | ${}^mC_{ks}T_{ks}T_{ds}G_{ds}{}^mC_{ds}A_{ds}G_{ds}G_{ds}T_{ds}G_{ds}A_{es}G_{es}{}^mC_{es}{}^mC_{ks}G_k$ | 31 | 4962 |
| 1207083 | 1786 | 1801 | 7174 | 7189 | $G_{ks}A_{ks}T_{ds}G_{ds}A_{ds}T_{ds}G_{ds}{}^mC_{ds}{}^mC_{ds}T_{ds}T_{ds}G_{es}{}^mC_{es}A_{es}G_{ks}G_k$ | 18 | 4963 |
| 1207091 | 1892 | 1907 | 7280 | 7295 | ${}^mC_{ks}{}^mC_{ks}{}^mC_{ds}T_{ds}G_{ds}A_{ds}G_{ds}{}^mC_{ds}A_{ds}A_{ds}T_{ds}{}^mC_{es}A_{es}G_{es}G_{ks}A_k$ | 48 | 3530 |
| 1207099 | 1900 | 1915 | 7288 | 7303 | $A_{ks}G_{ks}A_{ds}T_{ds}G_{ds}A_{ds}G_{ds}T_{ds}{}^mC_{ds}{}^mC_{ds}{}^mC_{ds}T_{es}G_{es}A_{es}G_{ks}{}^mC_k$ | 18 | 2614 |
| 1207107 | 1915 | 1930 | 7303 | 7318 | $T_{ks}{}^mC_{es}A_{ds}{}^mC_{ds}{}^mC_{ds}A_{ds}A_{ds}G_{ds}G_{ds}A_{ds}G_{ds}G_{es}A_{es}A_{ks}A_k$ | 20 | 4948 |
| 1207115 | 1923 | 1938 | 7311 | 7326 | ${}^mC_{ks}T_{ds}G_{ds}{}^mC_{ds}G_{ds}G_{ds}A_{ds}A_{ds}T_{ds}{}^mC_{ds}A_{ds}{}^mC_{es}{}^mC_{es}A_{es}A_{ks}G_k$ | 10 | 3531 |
| 1207129 | 1931 | 1946 | 7319 | 7334 | ${}^mC_{ks}T_{ks}{}^mC_{ds}T_{ds}{}^mC_{ds}T_{ds}{}^mC_{ds}A_{ds}{}^mC_{ds}T_{ds}G_{ds}{}^mC_{es}G_{es}G_{es}A_{ks}A_k$ | 8 | 2461 |
| 1207144 | 2001 | 2016 | 7389 | 7404 | $G_{ks}{}^mC_{ks}G_{ds}{}^mC_{ds}{}^mC_{ds}A_{ds}T_{ds}{}^mC_{ds}{}^mC_{ds}T_{ds}G_{ds}G_{es}{}^mC_{es}G_{es}{}^mC_{ks}G_k$ | 74 | 4964 |
| 1207152 | 2009 | 2024 | 7397 | 7412 | $G_{ks}A_{ks}G_{ds}T_{ds}T_{ds}{}^mC_{ds}{}^mC_{ds}T_{ds}G_{ds}{}^mC_{ds}G_{ds}{}^mC_{es}{}^mC_{es}A_{es}T_{ks}{}^mC_k$ | 16 | 3837 |
| 1207160 | 2018 | 2033 | 7406 | 7421 | ${}^mC_{ks}A_{ks}{}^mC_{ds}T_{ds}T_{ds}T_{ds}T_{ds}A_{ds}T_{ds}T_{ds}G_{ds}A_{es}G_{es}T_{es}{}^mC_{ks}{}^mC_k$ | 8 | 2924 |
| 1207168 | 2033 | 2048 | 7421 | 7436 | $T_{ks}{}^mC_{ks}A_{ds}G_{ds}{}^mC_{ds}A_{ds}T_{ds}T_{ds}T_{ds}T_{ds}{}^mC_{ds}A_{es}A_{es}A_{es}G_{ks}{}^mC_k$ | 29 | 3534 |
| 1207176 | 148 | 163 | 515 | 530 | $G_{ks}A_{ks}{}^mC_{ds}T_{ds}G_{ds}T_{ds}G_{ds}T_{ds}G_{ds}{}^mC_{ds}T_{ds}{}^mC_{es}T_{ks}T_{es}{}^mC_{ks}A_e$ | 16 | 3343 |
| 1207184 | 156 | 171 | N/A | N/A | $G_{ks}T_{ds}A_{ds}G_{ds}G_{ds}A_{ds}A_{ds}{}^mC_{ds}G_{ds}A_{ds}{}^mC_{ds}T_{es}G_{ks}T_{es}G_{ks}T_e$ | 18 | 2424 |
| 1207192 | 213 | 228 | 3564 | 3579 | $T_{ks}T_{ks}G_{ds}T_{ds}G_{ds}G_{ds}G_{ds}T_{ds}A_{ds}G_{ds}A_{ds}G_{ds}{}^mC_{es}G_{es}{}^mC_{ks}{}^mC_e$ | 25 | 2811 |
| 1207200 | 221 | 236 | 3572 | 3587 | $G_{ks}G_{ks}G_{ds}T_{ds}A_{ds}{}^mC_{ds}A_{ds}T_{ds}T_{ds}T_{ds}G_{ds}T_{es}G_{ks}G_{es}T_{ks}A_e$ | 51 | 3345 |
| 1207208 | 1781 | 1796 | 7169 | 7184 | $T_{ks}G_{ks}{}^mC_{ds}{}^mC_{ds}T_{ds}T_{ds}G_{ds}{}^mC_{ds}A_{ds}G_{ds}G_{ds}G_{ds}T_{es}G_{es}A_{ks}G_e$ | 45 | 3527 |
| 1207216 | 1789 | 1804 | 7177 | 7192 | $G_{ks}{}^mC_{ks}T_{ds}G_{ds}A_{ds}T_{ds}G_{ds}A_{ds}T_{ds}G_{ds}{}^mC_{ds}{}^mC_{es}T_{ks}T_{es}G_{ks}{}^mC_e$ | 17 | 3755 |

TABLE 84-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207224 | 1895 | 1910 | 7283 | 7298 | $A_{ks}G_{ks}T_{ds}C_{ds}C_{ds}C_{ds}T_{ds}G_{ds}A_{ds}G_{ds}C_{ds}A_{es}A_{ks}T_{es}{}^mC_{ks}A_e$ | 18 | 3758 |
| 1207232 | 1903 | 1918 | 7291 | 7306 | $G_{ks}A_{ks}A_{ds}A_{ds}G_{ds}A_{ds}T_{ds}G_{ds}A_{ds}G_{ds}T_{ds}C_{es}{}^mC_{ks}{}^mC_{es}T_{ks}G_e$ | 13 | 2845 |
| 1207240 | 1918 | 1933 | 7306 | 7321 | $G_{ks}A_{ks}A_{ds}T_{ds}C_{ds}A_{ds}C_{ds}C_{ds}A_{ds}A_{ds}G_{ds}G_{es}A_{ks}G_{es}G_{ks}G_e$ | 18 | 4965 |
| 1207248 | 1926 | 1941 | 7314 | 7329 | $T_{ks}C_{ks}A_{ds}C_{ds}T_{ds}G_{ds}C_{ds}G_{ds}G_{ds}A_{ds}A_{ds}T_{es}{}^mC_{ks}A_{es}{}^mC_{ks}{}^mC_e$ | 6 | 3759 |
| 1207256 | 1934 | 1949 | 7322 | 7337 | ${}^mC_{ks}{}^mC_{ks}A_{ds}{}^mC_{ds}T_{ds}{}^mC_{ds}T_{ds}{}^mC_{ds}T_{ds}{}^mC_{ds}A_{ds}{}^mC_{es}T_{ks}G_{es}{}^mC_{ks}G_e$ | 19 | 4949 |
| 1207264 | 2004 | 2019 | 7392 | 7407 | ${}^mC_{ks}{}^mC_{ks}T_{ds}G_{ds}{}^mC_{ds}G_{ds}{}^mC_{ds}{}^mC_{ds}A_{ds}T_{ds}{}^mC_{ds}{}^mC_{es}T_{ks}G_{es}G_{ks}C_e$ | 18 | 3457 |
| 1207272 | 2012 | 2027 | 7400 | 7415 | $A_{ks}T_{ks}T_{ds}G_{ds}A_{ds}G_{ds}T_{ds}T_{ds}C_{ds}{}^mC_{ds}T_{ds}G_{es}{}^mC_{ks}G_{es}{}^mC_{ks}{}^mC_e$ | 22 | 2540 |
| 1207280 | 2021 | 2036 | 7409 | 7424 | $A_{ks}A_{ks}G_{ds}C_{ds}A_{ds}C_{ds}T_{ds}T_{ds}T_{ds}A_{ds}T_{ds}T_{es}G_{ks}A_{es}G_{ks}T_e$ | 9 | 3147 |
| 1207288 | 143 | 158 | 510 | 525 | $T_{ks}G_{ks}T_{ds}G_{ds}C_{ds}T_{ds}C_{ds}T_{ds}T_{ds}C_{ds}A_{ds}G_{ks}{}^mC_{es}T_{ks}T_{es}T_k$ | 12 | 3037 |
| 1207296 | 151 | 166 | N/A | N/A | $A_{ks}A_{ks}C_{ds}G_{ds}A_{ds}C_{ds}T_{ds}G_{ds}T_{ds}G_{ds}T_{ds}G_{ks}{}^mC_{es}T_{ks}{}^mC_{es}T_k$ | 33 | 3571 |
| 1207304 | 208 | 223 | 3559 | 3574 | $G_{ks}T_{ks}A_{ds}{}^mC_{ds}A_{ds}A_{ds}G_{ds}{}^mC_{ds}T_{ds}G_{ds}{}^mC_{ds}{}^mC_{ds}G_{ks}G_{es}T_{ks}G_{es}G_k$ | 21 | 4968 |
| 1207312 | 216 | 231 | 3567 | 3582 | ${}^mC_{ks}A_{ks}T_{ds}T_{ds}T_{ds}G_{ds}T_{ds}G_{ds}G_{ds}T_{ds}A_{ds}{}^mC_{ks}A_{es}G_{ks}{}^mC_{es}T_k$ | 6 | 3039 |
| 1207320 | 1776 | 1791 | 7164 | 7179 | $T_{ks}G_{ks}{}^mC_{ds}A_{ds}G_{ds}G_{ds}G_{ds}T_{ds}G_{ds}A_{ds}G_{ds}{}^mC_{ks}{}^mC_{es}G_{ks}G_{es}{}^mC_k$ | 58 | 3299 |
| 1207328 | 1784 | 1799 | 7172 | 7187 | $T_{ks}G_{ks}A_{ds}T_{ds}G_{ds}{}^mC_{ds}{}^mC_{ds}T_{ds}T_{ds}G_{ds}{}^mC_{ds}A_{ks}G_{es}G_{ks}G_{es}T_k$ | 42 | 4969 |
| 1207336 | 1792 | 1807 | 7180 | 7195 | $C_{ks}C_{ks}A_{ds}G_{ds}C_{ds}T_{ds}G_{ds}A_{ds}T_{ds}G_{ds}A_{ds}T_{ks}G_{es}C_{ks}C_{es}T_k$ | 25 | 4970 |
| 1207344 | 1898 | 1913 | 7286 | 7301 | $A_{ks}T_{ks}G_{ds}A_{ds}G_{ds}T_{ds}C_{ds}C_{ds}C_{ds}T_{ds}G_{ds}A_{ks}G_{es}{}^mC_{ks}A_{es}A_k$ | 30 | 2460 |
| 1207352 | 1906 | 1921 | 7294 | 7309 | $A_{ks}G_{ks}G_{ds}G_{ds}A_{ds}A_{ds}A_{ds}G_{ds}A_{ds}T_{ds}G_{ds}A_{ks}G_{es}T_{ks}{}^mC_{es}{}^mC_k$ | 18 | 3073 |
| 1207360 | 1921 | 1936 | 7309 | 7324 | $G_{ks}{}^mC_{ks}G_{ds}G_{ds}A_{ds}A_{ds}T_{ds}{}^mC_{ds}A_{ds}{}^mC_{ds}{}^mC_{ds}A_{ks}A_{es}G_{ks}G_{es}A_k$ | 6 | 3379 |
| 1207368 | 1929 | 1944 | 7317 | 7332 | ${}^mC_{ks}T_{ks}{}^mC_{ds}T_{ds}{}^mC_{ds}A_{ds}{}^mC_{ds}T_{ds}G_{ds}{}^mC_{ds}G_{ds}G_{ks}A_{es}A_{ks}T_{es}{}^mC_k$ | 16 | 4971 |
| 1207376 | 1937 | 1952 | 7325 | 7340 | ${}^mC_{ks}A_{ks}G_{ds}{}^mC_{ds}{}^mC_{ds}A_{ds}{}^mC_{ds}T_{ds}{}^mC_{ds}T_{ds}C_{ds}T_{ks}{}^mC_{es}A_{ks}{}^mC_{es}T_k$ | 11 | 4972 |
| 1207384 | 2007 | 2022 | 7395 | 7410 | $G_{ks}T_{ks}T_{ds}{}^mC_{ds}{}^mC_{ds}T_{ds}G_{ds}{}^mC_{ds}G_{ds}{}^mC_{ds}{}^mC_{ds}A_{ks}T_{es}{}^mC_{ks}{}^mC_{es}T_k$ | 15 | 3685 |
| 1207392 | 2016 | 2031 | 7404 | 7419 | $C_{ks}T_{ks}T_{ds}T_{ds}A_{ds}T_{ds}T_{ds}G_{ds}A_{ds}G_{ds}T_{ds}T_{ks}{}^mC_{es}{}^mC_{es}T_{es}G_k$ | 11 | 2771 |
| 1207400 | 2024 | 2039 | 7412 | 7427 | $T_{ks}C_{ks}A_{ds}A_{ds}A_{ds}G_{ds}C_{ds}A_{ds}C_{ds}T_{ds}T_{ds}T_{ks}A_{es}T_{ks}T_{es}G_k$ | 21 | 3382 |

TABLE 84-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207408 | 146 | 161 | 513 | 528 | $^mC_{ks}T_{ks}G_{ks}T_{ds}G_{ds}T_{ds}G_{ds}{}^mC_{ds}T_{ds}{}^mC_{ds}T_{ds}T_{ds}{}^mC_{ks}A_{ks}G_{ks}{}^mC_e$ | 20 | 3190 |
| 1207416 | 154 | 169 | N/A | N/A | $G_{ks}A_{ks}G_{ks}A_{ds}A_{ds}{}^mC_{ds}G_{ds}A_{ds}{}^mC_{ds}T_{ds}G_{ds}T_{ds}G_{ks}T_{ks}G_{ks}{}^mC_e$ | 24 | 3799 |
| 1207424 | 211 | 226 | 3562 | 3577 | $G_{ks}T_{ks}G_{ks}G_{ds}T_{ds}A_{ds}{}^mC_{ds}A_{ds}G_{ds}{}^mC_{ds}T_{ds}G_{ds}C_{ds}C_{ks}G_{ks}G_e$ | 41 | 4973 |
| 1207432 | 219 | 234 | 3570 | 3585 | $G_{ks}T_{ks}A_{ks}C_{ds}A_{ds}T_{ds}T_{ds}G_{ds}T_{ds}G_{ds}G_{ds}T_{ks}A_{ks}{}^mC_{ks}A_e$ | 50 | 3192 |
| 1207440 | 1779 | 1794 | 7167 | 7182 | $^mC_{ks}{}^mC_{ks}T_{ks}T_{ds}G_{ds}{}^mC_{ds}A_{ds}G_{ds}G_{ds}G_{ds}T_{ds}G_{ds}A_{ks}G_{ks}{}^mC_{ks}{}^mC_e$ | 34 | 4974 |
| 1207448 | 1787 | 1802 | 7175 | 7190 | $T_{ks}G_{ks}A_{ks}T_{ds}G_{ds}A_{ds}T_{ds}G_{ds}{}^mC_{ds}{}^mC_{ds}T_{ds}T_{ds}G_{ks}{}^mC_{ks}A_{ks}G_e$ | 25 | 4975 |
| 1207456 | 1893 | 1908 | 7281 | 7296 | $T_{ks}C_{ks}C_{ks}C_{ds}T_{ds}G_{ds}A_{ds}G_{ds}C_{ds}A_{ds}A_{ds}T_{ds}C_{ks}A_{ks}G_{ks}G_e$ | 21 | 3606 |
| 1207464 | 1901 | 1916 | 7289 | 7304 | $A_{ks}A_{ks}G_{ks}A_{ds}T_{ds}G_{ds}A_{ds}G_{ds}T_{ds}{}^mC_{ds}{}^mC_{ds}C_{ds}T_{ks}G_{ks}A_{ks}G_e$ | 22 | 2691 |
| 1207472 | 1916 | 1931 | 7304 | 7319 | $A_{ks}T_{ks}{}^mC_{ks}A_{ds}{}^mC_{ds}{}^mC_{ds}A_{ds}A_{ds}G_{ds}G_{ds}A_{ds}G_{ds}G_{ks}G_{ks}A_{ks}A_e$ | 10 | 4966 |
| 1207480 | 1924 | 1939 | 7312 | 7327 | $A_{ks}C_{ks}T_{ks}G_{ds}C_{ds}G_{ds}G_{ds}A_{ds}A_{ds}T_{ds}C_{ds}A_{ds}{}^mC_{ks}{}^mC_{ks}A_{ks}A_e$ | 2 | 3607 |
| 1207488 | 1932 | 1947 | 7320 | 7335 | $A_{ks}{}^mC_{ks}T_{ks}{}^mC_{ds}T_{ds}{}^mC_{ds}T_{ds}C_{ds}A_{ds}C_{ds}T_{ds}G_{ds}{}^mC_{ks}G_{ks}G_{ks}A_e$ | 6 | 4976 |
| 1207496 | 2002 | 2017 | 7390 | 7405 | $T_{ks}G_{ks}C_{ks}G_{ds}C_{ds}C_{ds}A_{ds}T_{ds}{}^mC_{ds}{}^mC_{ds}T_{ds}G_{ds}G_{ks}{}^mC_{ks}G_{ks}{}^mC_e$ | 73 | 3305 |
| 1207504 | 2010 | 2025 | 7398 | 7413 | $T_{ks}G_{ks}A_{ks}G_{ds}T_{ds}T_{ds}C_{ds}C_{ds}T_{ds}G_{ds}C_{ds}G_{ds}{}^mC_{ks}{}^mC_{ks}A_{ks}T_e$ | 5 | 3913 |
| 1207512 | 2019 | 2034 | 7407 | 7422 | $G_{ks}{}^mC_{ks}A_{ks}{}^mC_{ds}T_{ds}T_{ds}T_{ds}A_{ds}T_{ds}G_{ds}A_{ds}G_{ks}T_{ks}T_{ks}{}^mC_e$ | 3 | 3000 |

TABLE 85

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1129531 | 2009 | 2024 | 7397 | 7412 | $G_{ks}A_{ks}G_{ks}T_{ds}T_{ds}{}^mC_{ds}{}^mC_{ds}T_{ds}G_{ds}{}^mC_{ds}G_{ds}{}^mC_{ds}{}^mC_{ds}A_{ks}T_{ks}{}^mC_k$ | 15 | 3837 |
| 1129532 | 2010 | 2025 | 7398 | 7413 | $T_{ks}G_{ks}A_{ks}G_{ds}T_{ds}T_{ds}{}^mC_{ds}{}^mC_{ds}T_{ds}G_{ds}{}^mC_{ds}G_{ds}C_{ds}C_{ks}A_{ks}T_k$ | 7 | 3913 |
| 1206485 | 1914 | 1929 | 7302 | 7317 | $^mC_{ks}A_{ks}{}^mC_{ks}{}^mC_{ds}A_{ds}A_{ds}G_{ds}G_{ds}A_{ds}G_{ds}G_{ds}G_{ds}A_{ks}A_{ks}G_k$ | 27 | 4954 |
| 1206490 | 1933 | 1948 | 7321 | 7336 | $^mC_{ks}A_{ks}{}^mC_{ks}T_{ds}{}^mC_{ds}T_{ds}{}^mC_{ds}T_{ds}{}^mC_{ds}A_{ds}{}^mC_{ds}T_{ds}G_{ds}{}^mC_{ks}G_{ks}G_k$ | 6 | 4957 |
| 1206499 | 1779 | 1794 | 7167 | 7182 | $^mC_{ks}{}^mC_{ks}T_{ks}T_{ds}G_{ds}{}^mC_{ds}A_{ds}G_{ds}G_{ds}G_{ds}T_{ds}G_{ds}A_{ks}G_{ks}{}^mC_{ks}{}^mC_k$ | 36 | 4974 |

TABLE 85-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1206900 | 143 | 158 | 510 | 525 | $T_{ks}G_{es}T_{ks}G_{ds}C_{ds}T_{ds}C_{ds}T_{ds}T_{ds}C_{ds}A_{ds}G_{ds}C_{es}T_{es}T_{ks}T_k$ | 24 | 3037 |
| 1206908 | 151 | 166 | N/A | N/A | $A_{ks}A_{es}{}^mC_{ks}G_{ds}A_{ds}{}^mC_{ds}T_{ds}G_{ds}T_{ds}G_{ds}T_{ds}{}^mC_{es}T_{es}{}^mC_{ks}T_k$ | 12 | 3571 |
| 1206916 | 208 | 223 | 3559 | 3574 | $G_{ks}T_{es}A_{ks}{}^mC_{ds}A_{ds}G_{ds}{}^mC_{ds}T_{ds}G_{ds}{}^mC_{ds}{}^mC_{ds}G_{ds}G_{es}T_{es}G_{ks}G_k$ | 32 | 4968 |
| 1206924 | 216 | 231 | 3567 | 3582 | $T_{ks}A_{es}T_{ks}T_{ds}T_{ds}G_{ds}T_{ds}G_{ds}G_{ds}T_{ds}A_{ds}{}^mC_{ds}A_{es}G_{es}{}^mC_{ks}T_k$ | 26 | 3039 |
| 1206932 | 1776 | 1791 | 7164 | 7179 | $T_{ks}G_{es}{}^mC_{ks}A_{ds}G_{ds}G_{ds}T_{ds}G_{ds}A_{ds}G_{ds}{}^mC_{ds}{}^mC_{es}G_{es}G_{ks}{}^mC_k$ | 40 | 3299 |
| 1206940 | 1784 | 1799 | 7172 | 7187 | $T_{ks}G_{es}A_{ks}T_{ds}G_{ds}{}^mC_{ds}{}^mC_{ds}T_{ds}T_{ds}G_{ds}{}^mC_{ds}A_{ds}G_{es}G_{es}G_{ks}T_k$ | 25 | 4969 |
| 1206948 | 1792 | 1807 | 7180 | 7195 | ${}^mC_{ks}{}^mC_{es}A_{ks}G_{ds}{}^mC_{ds}T_{ds}G_{ds}A_{ds}T_{ds}G_{ds}A_{ds}T_{ds}G_{es}{}^mC_{es}{}^mC_{ks}T_k$ | 24 | 4970 |
| 1206956 | 1898 | 1913 | 7286 | 7301 | $A_{ks}T_{es}G_{ks}A_{ds}G_{ds}T_{ds}{}^mC_{ds}{}^mC_{ds}T_{ds}G_{ds}A_{ds}G_{es}{}^mC_{es}A_{ks}A_k$ | 16 | 2460 |
| 1206964 | 1906 | 1921 | 7294 | 7309 | $A_{ks}G_{es}G_{ks}G_{ds}A_{ds}A_{ds}A_{ds}G_{ds}A_{ds}T_{ds}G_{ds}A_{ds}G_{es}T_{es}{}^mC_{ks}{}^mC_k$ | 21 | 3073 |
| 1206972 | 1921 | 1936 | 7309 | 7324 | $G_{ks}{}^mC_{es}G_{ks}G_{ds}A_{ds}A_{ds}T_{ds}{}^mC_{ds}A_{ds}{}^mC_{ds}{}^mC_{ds}A_{ds}A_{es}G_{es}G_{ks}A_k$ | 15 | 3379 |
| 1206980 | 1929 | 1944 | 7317 | 7332 | ${}^mC_{ks}T_{es}{}^mC_{ks}T_{ds}{}^mC_{ds}A_{ds}A_{ds}{}^mC_{ds}T_{ds}G_{ds}{}^mC_{ds}G_{ds}G_{ds}A_{es}A_{es}T_{ks}{}^mC_k$ | 8 | 4971 |
| 1206988 | 1937 | 1952 | 7325 | 7340 | ${}^mC_{ks}A_{es}G_{ks}{}^mC_{ds}{}^mC_{ds}A_{ds}{}^mC_{ds}T_{ds}T_{ds}{}^mC_{ds}T_{ds}{}^mC_{ds}T_{ds}{}^mC_{es}A_{es}{}^mC_{ks}T_k$ | 15 | 4972 |
| 1206996 | 2007 | 2022 | 7395 | 7410 | $G_{ks}T_{es}T_{ks}{}^mC_{ds}{}^mC_{ds}T_{ds}G_{ds}{}^mC_{ds}G_{ds}{}^mC_{ds}{}^mC_{ds}A_{ds}T_{es}{}^mC_{es}{}^mC_{ks}T_k$ | 10 | 3685 |
| 1207004 | 2016 | 2031 | 7404 | 7419 | ${}^mC_{ks}T_{es}T_{ks}T_{ds}A_{ds}T_{ds}G_{ds}A_{ds}A_{ds}G_{ds}T_{ds}T_{ds}{}^mC_{es}{}^mC_{es}T_{ks}G_k$ | 7 | 2771 |
| 1207012 | 2024 | 2039 | 7412 | 7427 | $T_{ks}{}^mC_{es}A_{ks}A_{ds}A_{ds}G_{ds}{}^mC_{ds}A_{ds}{}^mC_{ds}T_{ds}T_{ds}T_{ds}A_{es}T_{es}G_{ks}G_k$ | 14 | 3382 |
| 1207031 | 146 | 161 | 513 | 528 | ${}^mC_{ks}T_{ks}G_{ds}T_{ds}G_{ds}T_{ds}G_{ds}{}^mC_{ds}T_{ds}{}^mC_{ds}T_{ds}T_{es}{}^mC_{es}A_{es}G_{ks}{}^mC_k$ | 24 | 3190 |
| 1207039 | 154 | 169 | N/A | N/A | $G_{ks}A_{ds}G_{ds}A_{ds}A_{ds}{}^mC_{ds}G_{ds}A_{ds}{}^mC_{ds}T_{ds}G_{ds}T_{es}G_{es}T_{es}G_{ks}{}^mC_k$ | 14 | 3799 |
| 1207047 | 211 | 226 | 3562 | 3577 | $G_{ks}T_{ks}G_{ds}G_{ds}T_{ds}A_{ds}{}^mC_{ds}A_{ds}G_{ds}{}^mC_{ds}T_{ds}G_{es}{}^mC_{es}{}^mC_{es}G_{ks}G_k$ | 18 | 4973 |
| 1207055 | 219 | 234 | 3570 | 3585 | $G_{ks}T_{ks}A_{ds}{}^mC_{ds}A_{ds}T_{ds}T_{ds}T_{ds}G_{ds}T_{ds}G_{ds}G_{es}T_{es}A_{es}{}^mC_{ks}A_k$ | 65 | 3192 |
| 1207063 | 1779 | 1794 | 7167 | 7182 | ${}^mC_{ks}{}^mC_{ks}T_{ds}G_{ds}{}^mC_{ds}A_{ds}G_{ds}G_{ds}G_{ds}T_{ds}G_{es}A_{es}G_{es}{}^mC_{ks}{}^mC_k$ | 32 | 4974 |
| 1207084 | 1787 | 1802 | 7175 | 7190 | $T_{ks}G_{ks}A_{ds}T_{ds}G_{ds}A_{ds}T_{ds}G_{ds}{}^mC_{ds}{}^mC_{ds}T_{ds}T_{es}G_{es}{}^mC_{es}A_{ks}G_k$ | 15 | 4975 |
| 1207092 | 1893 | 1908 | 7281 | 7296 | $T_{ks}{}^mC_{ks}{}^mC_{ds}{}^mC_{ds}T_{ds}G_{ds}A_{ds}G_{ds}{}^mC_{ds}A_{ds}A_{ds}T_{es}{}^mC_{es}A_{es}G_{ks}G_k$ | 29 | 3606 |
| 1207100 | 1901 | 1916 | 7289 | 7304 | $A_{ks}A_{ks}G_{ds}A_{ds}T_{ds}G_{ds}A_{ds}G_{ds}T_{ds}{}^mC_{ds}{}^mC_{ds}{}^mC_{es}T_{es}G_{es}A_{ks}G_k$ | 16 | 2691 |

TABLE 85-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207108 | 1916 | 1931 | 7304 | 7319 | $A_{ks}T_{ks}{}^mC_{ds}A_{ds}{}^mC_{ds}{}^mC_{ds}A_{ds}A_{ds}G_{ds}G_{ds}A_{ds}G_{es}G_{es}G_{es}A_{ks}A_k$ | 9 | 4966 |
| 1207116 | 1924 | 1939 | 7312 | 7327 | $A_{ks}{}^mC_{ks}T_{ds}G_{ds}{}^mC_{ds}G_{ds}G_{ds}A_{ds}A_{ds}T_{ds}{}^mC_{ds}A_{Es}{}^mC_{es}{}^mC_{es}{}^mC_{es}A_{ks}A_k$ | 10 | 3607 |
| 1207131 | 1932 | 1947 | 7320 | 7335 | $A_{ks}{}^mC_{ks}T_{ds}{}^mC_{ds}T_{ds}{}^mC_{ds}T_{ds}{}^mC_{ds}A_{ds}{}^mC_{ds}T_{ds}G_{es}{}^mC_{es}G_{es}G_{ks}A_k$ | 6 | 4976 |
| 1207145 | 2002 | 2017 | 7390 | 7405 | $T_{ks}G_{ks}{}^mC_{ds}G_{ds}{}^mC_{ds}{}^mC_{ds}A_{ds}T_{ds}{}^mC_{ds}{}^mC_{ds}T_{ds}G_{es}G_{es}{}^mC_{es}G_{ks}{}^mC_k$ | 46 | 3305 |
| 1207153 | 2010 | 2025 | 7398 | 7413 | $T_{ks}G_{ks}A_{ds}G_{ds}T_{ds}T_{ds}{}^mC_{ds}{}^mC_{ds}T_{ds}G_{ds}{}^mC_{ds}G_{es}C_{es}C_{es}A_{ks}T_k$ | 13 | 3913 |
| 1207161 | 2019 | 2034 | 7407 | 7422 | $G_{ks}{}^mC_{ks}A_{ds}{}^mC_{ds}T_{ds}T_{ds}T_{ds}A_{ds}T_{ds}T_{ds}G_{ds}A_{es}G_{es}T_{es}T_{ks}{}^mC_k$ | 17 | 3000 |
| 1207169 | 141 | 156 | 508 | 523 | $T_{ks}G_{ks}{}^mC_{ds}T_{ds}{}^mC_{ds}T_{ds}T_{ds}{}^mC_{ds}A_{ds}G_{ds}{}^mC_{ds}T_{es}T_{ks}T_{es}G_{ks}T_e$ | 33 | 4950 |
| 1207177 | 149 | 164 | 516 | 531 | ${}^mC_{ks}G_{ks}A_{ds}{}^mC_{ds}T_{ds}G_{ds}T_{ds}G_{ds}T_{ds}G_{ds}{}^mC_{ds}T_{es}{}^mC_{ks}T_{es}T_{ks}{}^mC_e$ | 17 | 3419 |
| 1207185 | 157 | 172 | N/A | N/A | $A_{ks}G_{ks}T_{ds}G_{ds}A_{ds}G_{ds}A_{ds}A_{ds}{}^mC_{ds}G_{ds}A_{ds}{}^mC_{es}T_{ks}G_{es}T_{ks}G_e$ | 15 | 2502 |
| 1207193 | 214 | 229 | 3565 | 3580 | $T_{ks}T_{ks}T_{ds}G_{ds}T_{ds}G_{ds}G_{ds}T_{ds}A_{ds}C_{ds}A_{ds}G_{es}{}^mC_{ks}T_{es}G_{ks}{}^mC_e$ | 17 | 2887 |
| 1207201 | 222 | 237 | 3573 | 3588 | $T_{ks}G_{ks}G_{ds}G_{ks}T_{ds}A_{ds}C_{ds}A_{ds}T_{ds}T_{ds}T_{ds}G_{es}T_{ks}G_{es}G_{ks}T_e$ | 25 | 3421 |
| 1207209 | 1782 | 1797 | 7170 | 7185 | $A_{ks}T_{ks}G_{ds}{}^mC_{ds}{}^mC_{ds}T_{ds}T_{ds}G_{ds}{}^mC_{ds}A_{ds}G_{ds}G_{es}G_{ks}T_{es}G_{ks}A_e$ | 26 | 4947 |
| 1207217 | 1790 | 1805 | 7178 | 7193 | $A_{ks}G_{ks}{}^mC_{ds}T_{ds}G_{ds}A_{ds}T_{ds}G_{ds}G_{ds}A_{ds}T_{ds}G_{ds}{}^mC_{es}{}^mC_{ks}T_{es}T_{ks}G_e$ | 22 | 3831 |
| 1207225 | 1896 | 1911 | 7284 | 7299 | $G_{ks}A_{ks}G_{ds}T_{ds}{}^mC_{ds}{}^mC_{ds}{}^mC_{ds}T_{ds}G_{ds}A_{ds}G_{ds}C_{es}A_{ks}A_{es}T_{ks}C_e$ | 7 | 3834 |
| 1207233 | 1904 | 1919 | 7292 | 7307 | $G_{ks}G_{ks}A_{ds}A_{ds}A_{ds}G_{ds}A_{ds}T_{ds}G_{ds}A_{ds}G_{ds}T_{es}C_{ks}C_{es}C_{ks}T_e$ | 31 | 2921 |
| 1207241 | 1919 | 1934 | 7307 | 7322 | $G_{ks}A_{ks}A_{ds}A_{ds}T_{ds}C_{ds}A_{ds}{}^mC_{ds}C_{ds}A_{ds}A_{ds}G_{es}G_{ks}A_{es}G_{ks}G_e$ | 21 | 3226 |
| 1207249 | 1927 | 1942 | 7315 | 7330 | ${}^mC_{ks}T_{ks}{}^mC_{ds}A_{ds}{}^mC_{ds}T_{ds}G_{ds}{}^mC_{ds}G_{ds}G_{ds}A_{ds}A_{es}T_{ks}{}^mC_{es}A_{ks}{}^mC_e$ | 12 | 3835 |
| 1207257 | 1935 | 1950 | 7323 | 7338 | $G_{ks}{}^mC_{ks}{}^mC_{ds}A_{ds}{}^mC_{ds}A_{ds}{}^mC_{ds}T_{ds}{}^mC_{ds}T_{ds}{}^mC_{ds}A_{es}{}^mC_{es}{}^mC_{ks}T_{es}G_{ks}{}^mC_e$ | 25 | 4967 |
| 1207265 | 2005 | 2020 | 7393 | 7408 | $T_{ks}C_{ks}C_{ds}T_{ds}G_{ds}G_{ds}G_{ds}C_{ds}C_{ds}A_{ds}T_{ds}{}^mC_{es}{}^mC_{ks}T_{es}G_{ks}G_e$ | 24 | 3533 |
| 1207273 | 2013 | 2028 | 7401 | 7416 | $T_{ks}A_{ks}T_{ds}T_{ds}G_{ds}A_{ds}G_{ds}T_{ds}T_{ds}{}^mC_{ds}{}^mC_{ds}T_{es}G_{ks}{}^mC_{es}G_{ks}{}^mC_e$ | 21 | 2617 |
| 1207281 | 2022 | 2037 | 7410 | 7425 | $A_{ks}A_{ks}A_{ds}G_{ds}{}^mC_{ds}A_{ds}{}^mC_{ds}T_{ds}T_{ds}T_{ds}A_{ds}T_{es}T_{ks}G_{es}A_{ks}G_e$ | 21 | 3229 |
| 1207289 | 144 | 159 | 511 | 526 | $G_{ks}T_{ks}G_{ds}T_{ds}G_{ds}{}^mC_{ds}T_{ds}{}^mC_{ds}T_{ds}T_{ds}{}^mC_{ds}A_{ks}G_{es}{}^mC_{ks}T_{es}T_k$ | 20 | 4951 |
| 1207297 | 152 | 167 | N/A | N/A | $G_{ks}A_{ks}A_{ds}{}^mC_{ds}G_{ds}A_{ds}{}^mC_{ds}T_{ds}G_{ds}T_{ds}G_{ds}T_{ks}G_{es}{}^mC_{ks}T_{es}{}^mC_k$ | 23 | 3647 |

TABLE 85-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207305 | 209 | 224 | 3560 | 3575 | $G_{ks}G_{ks}T_{ds}A_{ds}{}^mC_{ds}A_{ds}G_{ds}C_{ds}T_{ds}G_{ds}C_{ds}{}^mC_{ks}G_{es}G_{ks}T_{es}G_k$ | 23 | 4952 |
| 1207313 | 217 | 232 | 3568 | 3583 | $A_{ks}C_{ks}A_{ds}T_{ds}T_{ds}G_{ds}T_{ds}G_{ds}G_{ds}T_{ds}A_{ks}{}^mC_{es}A_{ks}G_{es}{}^mC_k$ | 12 | 3114 |
| 1207321 | 1777 | 1792 | 7165 | 7180 | $T_{ks}T_{ks}G_{ds}{}^mC_{ds}A_{ds}G_{ds}G_{ds}G_{ds}T_{ds}G_{ds}A_{ds}G_{ks}{}^mC_{es}{}^mC_{ks}G_{es}G_k$ | 36 | 3375 |
| 1207329 | 1785 | 1800 | 7173 | 7188 | $A_{ks}T_{ks}G_{ds}A_{ds}T_{ds}G_{ds}C_{ds}C_{ds}T_{ds}T_{ds}G_{ds}{}^mC_{ks}A_{es}G_{ks}G_{es}G_k$ | 21 | 3603 |
| 1207337 | 1793 | 1808 | 7181 | 7196 | ${}^mC_{ks}{}^mC_{ks}{}^mC_{ds}A_{ds}G_{ds}{}^mC_{ds}T_{ds}G_{ds}G_{ds}A_{ds}T_{ds}G_{ds}A_{ks}T_{es}G_{ks}{}^mC_{es}{}^mC_k$ | 53 | 4953 |
| 1207345 | 1899 | 1914 | 7287 | 7302 | $G_{ks}A_{ks}T_{ds}G_{ds}A_{ds}G_{ds}T_{ds}{}^mC_{ds}{}^mC_{ds}{}^mC_{ds}T_{ds}G_{ks}A_{es}G_{ks}C_{es}A_k$ | 12 | 2537 |
| 1207353 | 1914 | 1929 | 7302 | 7317 | ${}^mC_{ks}A_{ks}{}^mC_{ds}{}^mC_{ds}A_{ds}A_{ds}G_{ds}G_{ds}A_{ds}G_{ds}G_{ds}G_{ks}A_{es}A_{ks}A_{es}G_k$ | 22 | 4954 |
| 1207361 | 1922 | 1937 | 7310 | 7325 | $T_{ks}G_{ks}{}^mC_{ds}G_{ds}G_{ds}G_{ds}A_{ds}A_{ds}T_{ds}{}^mC_{ds}A_{ds}{}^mC_{ds}{}^mC_{ks}A_{es}A_{ks}G_{es}G_k$ | 11 | 3455 |
| 1207369 | 1930 | 1945 | 7318 | 7333 | $T_{ks}C_{ks}T_{ds}C_{ds}T_{ds}C_{ds}A_{ds}A_{ds}C_{ds}T_{ds}G_{ds}{}^mC_{ds}G_{ks}G_{es}A_{ks}A_{es}T_k$ | 13 | 4955 |
| 1207377 | 2000 | 2015 | 7388 | 7403 | ${}^mC_{ks}G_{ks}{}^mC_{ds}{}^mC_{ds}A_{ds}A_{ds}{}^mC_{ds}{}^mC_{ds}T_{ds}G_{ds}G_{ds}{}^mC_{ks}G_{es}{}^mC_{ks}G_{es}G_k$ | 42 | 3228 |
| 1207385 | 2008 | 2023 | 7396 | 7411 | $A_{ks}G_{ks}T_{ds}T_{ds}{}^mC_{ds}{}^mC_{ds}T_{ds}G_{ds}{}^mC_{ds}G_{ds}{}^mC_{ds}{}^mC_{ks}A_{es}T_{ks}{}^mC_{es}{}^mC_k$ | 14 | 3761 |
| 1207393 | 2017 | 2032 | 7405 | 7420 | $A_{ks}{}^mC_{ds}T_{ds}T_{ds}T_{ds}A_{ds}T_{ds}G_{ds}A_{ds}G_{ds}T_{ks}T_{es}{}^mC_{ks}C_{es}T_k$ | 7 | 2848 |
| 1207401 | 2031 | 2046 | 7419 | 7434 | $A_{ks}G_{ks}C_{ds}A_{ds}T_{ds}T_{ds}T_{ds}T_{ds}{}^mC_{ds}A_{ds}A_{ds}A_{ks}G_{es}{}^mC_{ks}A_{es}{}^mC_k$ | 10 | 3458 |
| 1207409 | 147 | 162 | 514 | 529 | $A_{ks}{}^mC_{ks}T_{ks}G_{ds}T_{ds}G_{ds}T_{ds}G_{ds}{}^mC_{ds}T_{ds}{}^mC_{ds}T_{ks}{}^mC_{ks}A_{ks}G_e$ | 21 | 3267 |
| 1207417 | 155 | 170 | N/A | N/A | $T_{ks}G_{ks}A_{ks}G_{ds}A_{ds}A_{ds}{}^mC_{ds}G_{ds}G_{ds}A_{ds}{}^mC_{ds}T_{ds}G_{ks}T_{ks}G_{ks}T_{ks}G_e$ | 35 | 3875 |
| 1207425 | 212 | 227 | 3563 | 3578 | $T_{ks}G_{ks}T_{ks}G_{ds}G_{ds}T_{ds}A_{ds}{}^mC_{ds}A_{ds}G_{ds}{}^mC_{ds}T_{ds}G_{ks}{}^mC_{ks}G_{ks}C_e$ | 30 | 2734 |
| 1207433 | 220 | 235 | 3571 | 3586 | $G_{ks}G_{ks}T_{ks}A_{ds}{}^mC_{ds}A_{ds}G_{ds}T_{ds}T_{ds}G_{ds}T_{ds}G_{ds}G_{ks}T_{ks}A_{ks}{}^mC_e$ | 23 | 3269 |
| 1207441 | 1780 | 1795 | 7168 | 7183 | $G_{ks}{}^mC_{ks}{}^mC_{ks}T_{ds}T_{ds}G_{ds}{}^mC_{ds}A_{ds}G_{ds}G_{ds}G_{ds}T_{ds}G_{ks}A_{ks}G_{ks}{}^mC_e$ | 26 | 3451 |
| 1207449 | 1788 | 1803 | 7176 | 7191 | ${}^mC_{ks}T_{ks}G_{ks}A_{ds}T_{ds}G_{ds}A_{ds}T_{ds}G_{ds}{}^mC_{ds}{}^mC_{ds}T_{ds}T_{ks}G_{ks}{}^mC_{ks}A_e$ | 25 | 3679 |
| 1207457 | 1894 | 1909 | 7282 | 7297 | $G_{ks}T_{ks}{}^mC_{ks}{}^mC_{ds}T_{ds}G_{ds}A_{ds}G_{ds}{}^mC_{ds}A_{ds}A_{ds}T_{ks}{}^mC_{ks}A_{ks}G_e$ | 25 | 3682 |
| 1207465 | 1902 | 1917 | 7290 | 7305 | $A_{ks}A_{ks}A_{ks}G_{ds}A_{ds}T_{ds}G_{ds}A_{ds}G_{ds}T_{ds}C_{ds}{}^mC_{ds}{}^mC_{ks}T_{ks}G_{ks}A_e$ | 13 | 2768 |
| 1207473 | 1917 | 1932 | 7305 | 7320 | $A_{ks}A_{ks}T_{ks}C_{ds}C_{ds}C_{ds}A_{ds}A_{ds}G_{ds}G_{ds}A_{ds}G_{ks}G_{ks}G_{ks}A_e$ | 23 | 4956 |
| 1207481 | 1925 | 1940 | 7313 | 7328 | ${}^mC_{ks}A_{ks}{}^mC_{ks}T_{ds}G_{ds}{}^mC_{ds}G_{ds}G_{ds}G_{ds}A_{ds}A_{ds}T_{ds}{}^mC_{ds}A_{ks}{}^mC_{ks}{}^mC_{ks}A_e$ | 4 | 3683 |

TABLE 85-continued

Reduction of FXII RNA (Huh7, electroporation, 4000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (% UTC) | SEQ ID NO |
|---|---|---|---|---|---|---|---|
| 1207489 | 1933 | 1948 | 7321 | 7336 | $^{m}C_{ks}A_{ks}{}^{m}C_{ks}T_{ds}{}^{m}C_{ds}T_{ds}{}^{m}C_{ds}T_{ds}{}^{m}C_{ds}A_{ds}{}^{m}C_{ds}T_{ds}G_{ks}{}^{m}C_{ks}G_{ks}G_{e}$ | 12 | 4957 |
| 1207497 | 2003 | 2018 | 7391 | 7406 | $^{m}C_{ks}T_{ks}G_{ks}{}^{m}C_{ds}G_{ds}{}^{m}C_{ds}{}^{m}C_{ds}A_{ds}T_{ds}{}^{m}C_{ds}{}^{m}C_{ds}T_{ds}G_{ks}G_{ks}{}^{m}C_{ks}G_{e}$ | 45 | 3381 |
| 1207505 | 2011 | 2026 | 7399 | 7414 | $T_{ks}T_{ks}G_{ks}A_{ds}G_{ds}T_{ds}T_{ds}{}^{m}C_{ds}{}^{m}C_{ds}T_{ds}G_{ds}{}^{m}C_{ds}G_{ks}{}^{m}C_{ks}{}^{m}C_{ks}A_{e}$ | 7 | 2463 |
| 1207513 | 2020 | 2035 | 7408 | 7423 | $A_{ks}G_{ks}C_{ks}A_{ds}{}^{m}C_{ds}T_{ds}T_{ds}T_{ds}A_{ds}T_{ds}T_{ds}G_{ds}A_{ks}G_{ks}T_{ks}T_{e}$ | 4 | 3076 |

TABLE 86

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (%UTC) | SEQ ID NO |
|---|---|---|---|---|---|---|---|
| 1128769 | 153 | 168 | N/A | N/A | $A_{ks}G_{ks}A_{ks}A_{ds}{}^{m}C_{ds}G_{ds}A_{ds}{}^{m}C_{ds}T_{ds}G_{ds}T_{ds}G_{ds}T_{ds}G_{ks}{}^{m}C_{ks}T_{k}$ | 19 | 3723 |
| 1128802 | 218 | 233 | 3569 | 3584 | $T_{ks}A_{ks}{}^{m}C_{ks}A_{ds}T_{ds}T_{ds}T_{ds}G_{ds}T_{ds}G_{ds}G_{ds}T_{ds}A_{ds}{}^{m}C_{ks}A_{ks}G_{k}$ | 108 | 2426 |
| 1128870 | 470 | 485 | 4415 | 4430 | $T_{ks}G_{ks}T_{ks}G_{ds}G_{ds}A_{ds}A_{ds}A_{ds}A_{ds}A_{ds}{}^{m}C_{ds}{}^{m}C_{ds}G_{ds}G_{ks}A_{ks}G_{k}$ | 31 | 3728 |
| 1129485 | 1921 | 1936 | 7309 | 7324 | $G_{ks}{}^{m}C_{ks}G_{ks}G_{ds}A_{ds}A_{ds}T_{ds}{}^{m}C_{ds}A_{ds}{}^{m}C_{ds}{}^{m}C_{ds}A_{ds}A_{ds}G_{ks}G_{ks}A_{k}$ | 20 | 3379 |
| 1129491 | 1927 | 1942 | 7315 | 7330 | $^{m}C_{ks}T_{ks}{}^{m}C_{ks}A_{ds}{}^{m}C_{ds}T_{ds}G_{ds}{}^{m}C_{ds}G_{ds}G_{ds}A_{ds}A_{ds}T_{ds}{}^{m}C_{ks}A_{ks}{}^{m}C_{k}$ | 17 | 3835 |
| 1129492 | 1928 | 1943 | 7316 | 7331 | $T_{ks}{}^{m}C_{ks}T_{ks}{}^{m}C_{ds}A_{ds}{}^{m}C_{ds}T_{ds}G_{ds}{}^{m}C_{ds}G_{ds}G_{ds}A_{ds}A_{ds}T_{ks}{}^{m}C_{ks}A_{k}$ | 7 | 3911 |
| 1129531 | 2009 | 2024 | 7397 | 7412 | $G_{ks}A_{ks}G_{ks}T_{ds}T_{ds}{}^{m}C_{ds}{}^{m}C_{ds}T_{ds}G_{ds}{}^{m}C_{ds}G_{ds}{}^{m}C_{ds}{}^{m}C_{ds}A_{ks}T_{ks}{}^{m}C_{k}$ | 17 | 3837 |
| 1129532 | 2010 | 2025 | 7398 | 7413 | $T_{ks}G_{ks}A_{ks}G_{ds}T_{ds}T_{ds}{}^{m}C_{ds}{}^{m}C_{ds}T_{ds}G_{ds}{}^{m}C_{ds}G_{ds}{}^{m}C_{ds}{}^{m}C_{ks}A_{ks}T_{k}$ | 6 | 3913 |
| 1129538 | 2017 | 2032 | 7405 | 7420 | $A_{ks}{}^{m}C_{ks}T_{ks}T_{ds}T_{ds}A_{ds}T_{ds}T_{ds}G_{ds}A_{ds}G_{ds}T_{ds}T_{ds}{}^{m}C_{ks}{}^{m}C_{ks}T_{k}$ | 7 | 2848 |
| 1129540 | 2019 | 2034 | 7407 | 7422 | $G_{ks}{}^{m}C_{ks}A_{ks}{}^{m}C_{ds}T_{ds}T_{ds}T_{ds}A_{ds}T_{ds}T_{ds}G_{ds}A_{ds}G_{ds}T_{ks}T_{ks}{}^{m}C_{k}$ | 3 | 3000 |
| 1129579 | N/A | N/A | 208 | 223 | $^{m}C_{ks}A_{ks}{}^{m}C_{ks}A_{ds}T_{ds}A_{ds}G_{ds}G_{ds}{}^{m}C_{ds}{}^{m}C_{ds}T_{ds}{}^{m}C_{ds}{}^{m}C_{ds}T_{ks}A_{ks}G_{k}$ | 55 | 2926 |
| 1129714 | N/A | N/A | 1558 | 1573 | $A_{ks}G_{ks}G_{ks}G_{ds}T_{ds}A_{ds}A_{ds}G_{ds}G_{ds}T_{ds}{}^{m}C_{ds}{}^{m}C_{ds}A_{ds}T_{ks}{}^{m}C_{ks}T_{k}$ | 63 | 2549 |
| 1129740 | N/A | N/A | 1758 | 1773 | $G_{ks}A_{ks}T_{ks}G_{ds}G_{ds}G_{ds}A_{ds}T_{ds}G_{ds}G_{ds}A_{ds}{}^{m}C_{ds}G_{ds}G_{ks}A_{ks}{}^{m}C_{k}$ | 69 | 3010 |
| 1129760 | N/A | N/A | 2284 | 2299 | $A_{ks}{}^{m}C_{ks}{}^{m}C_{ks}A_{ds}T_{ds}{}^{m}C_{ds}G_{ds}{}^{m}C_{ds}G_{ds}A_{ds}A_{ds}T_{ds}A_{ds}A_{ks}T_{ks}G_{k}$ | 44 | 3011 |
| 1129773 | N/A | N/A | 2450 | 2465 | $G_{ks}{}^{m}C_{ks}A_{ks}T_{ds}T_{ds}G_{ds}A_{ds}T_{ds}G_{ds}A_{ds}A_{ds}T_{ds}{}^{m}C_{ds}A_{ks}G_{ks}{}^{m}C_{k}$ | 28 | 2475 |

TABLE 86-continued

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (%UTC) | SEQ ID NO |
|---|---|---|---|---|---|---|---|
| 1129779 | N/A | N/A | 2470 | 2485 | $G_{ks}{}^mC_{ks}T_{ks}A_{ds}T_{ds}A_{ds}G_{ds}T_{ds}G_{ds}{}^mC_{ds}{}^mC_{ds}A_{ds}T_{ds}{}^mC_{ks}A_{ks}G_k$ | 27 | 2936 |
| 1129802 | N/A | N/A | 2654 | 2669 | $T_{ks}{}^mC_{ks}{}^mC_{ks}T_{ds}A_{ds}T_{ds}T_{ds}G_{ds}A_{ds}A_{ds}T_{ds}G_{ds}A_{ds}G_{ks}T_{ks}G_k$ | 33 | 3160 |
| 1129948 | N/A | N/A | 4840 | 4855 | $A_{ks}T_{ks}{}^mC_{ks}T_{ds}G_{ds}{}^mC_{ds}T_{ds}T_{ds}T_{ds}{}^mC_{ds}{}^mC_{ds}G_{ds}{}^mC_{ds}A_{ks}{}^mC_{ks}T_k$ | 51 | 3630 |
| 1129949 | N/A | N/A | 4844 | 4859 | $T_{ks}{}^mC_{ks}T_{ks}{}^mC_{ds}A_{ds}T_{ds}{}^mC_{ds}T_{ds}G_{ds}{}^mC_{ds}T_{ds}T_{ds}T_{ds}{}^mC_{ks}{}^mC_{ks}G_k$ | 24 | 3706 |
| 1130060 | N/A | N/A | 6178 | 6193 | $A_{ks}A_{ks}G_{ks}G_{ds}{}^mC_{ds}G_{ds}{}^mC_{ds}A_{ds}A_{ds}{}^mC_{ds}A_{ds}G_{ds}A_{ds}G_{ks}{}^mC_{ks}T_k$ | 22 | 3026 |
| 1130240 | N/A | N/A | 7098 | 7113 | $G_{ks}T_{ks}{}^mC_{ks}G_{ds}G_{ds}A_{ds}A_{ds}A_{ds}{}^mC_{ds}A_{ds}{}^mC_{ds}G_{ds}{}^mC_{ds}A_{ks}G_{ks}{}^mC_k$ | 47† | 3035 |
| 1213035 | 141 | 156 | 508 | 523 | $T_{ks}G_{ks}{}^mC_{ks}T_{ds}C_{ys}T_{ds}T_{ds}{}^mC_{ds}A_{ds}Gd_{ds}{}^mC_{ds}T_{ds}T_{ds}T_{ks}G_{ks}T_k$ | 40 | 4950 |
| 1213036 | 142 | 157 | 509 | 524 | $G_{ks}T_{ks}G_{ks}{}^mC_{ds}U_{ys}{}^mC_{ds}T_{ds}T_{ds}{}^mC_{ds}A_{ds}G_{ds}{}^mC_{ds}T_{ds}T_{ks}T_{ks}G_k$ | 28 | 4977 |
| 1213037 | 143 | 158 | 510 | 525 | $T_{ks}G_{ks}T_{ks}G_{ds}C_{ys}T_{ds}{}^mC_{ds}T_{ds}T_{ds}{}^mC_{ds}A_{ds}G_{ds}{}^mC_{ds}T_{ks}T_{ks}T_k$ | 46 | 3037 |
| 1213038 | 144 | 159 | 511 | 526 | $G_{ks}T_{ks}G_{ks}T_{ds}G_{ys}{}^mC_{ds}T_{ds}{}^mC_{ds}T_{ds}T_{ds}{}^mC_{ds}A_{ds}G_{ds}{}^mC_{ks}T_{ks}T_k$ | 33 | 4951 |
| 1213039 | 145 | 160 | 512 | 527 | $T_{ks}G_{ks}T_{ks}G_{ds}U_{ys}G_{ds}{}^mC_{ds}T_{ds}{}^mC_{ds}T_{ds}T_{ds}{}^mC_{ds}A_{ds}G_{ks}{}^mC_{ks}T_k$ | 91 | 4978 |
| 1213040 | 146 | 161 | 513 | 528 | ${}^mC_{ks}T_{ks}G_{ks}T_{ds}G_{ys}T_{ds}G_{ds}{}^mC_{ds}T_{ds}{}^mC_{ds}T_{ds}T_{ds}{}^mC_{ds}A_{ks}G_{ks}{}^mC_k$ | 35 | 3190 |
| 1213041 | 147 | 162 | 514 | 529 | $A_{ks}{}^mC_{ks}T_{ks}G_{ds}U_{ys}G_{ds}T_{ds}G_{ds}{}^mC_{ds}T_{ds}{}^mC_{ds}T_{ds}T_{ds}{}^mC_{ks}A_{ks}G_k$ | 27 | 4979 |
| 1213042 | 148 | 163 | 515 | 530 | $G_{ks}A_{ks}{}^mC_{ks}T_{ds}G_{ys}T_{ds}G_{ds}T_{ds}G_{ds}{}^mC_{ds}T_{ds}{}^mC_{ds}T_{ds}T_{ks}{}^mC_{ks}A_k$ | 50 | 3343 |
| 1213043 | 149 | 164 | 516 | 531 | ${}^mC_{ks}G_{ks}A_{ks}{}^mC_{ds}U_{ys}G_{ds}T_{ds}G_{ds}T_{ds}G_{ds}{}^mC_{ds}T_{ds}{}^mC_{ds}T_{ks}T_{ks}{}^mC_k$ | 65 | 4980 |
| 1213044 | 150 | 165 | N/A | N/A | $A_{ks}{}^mC_{ks}G_{ks}A_{ds}C_{ys}T_{ds}G_{ds}T_{ds}G_{ds}T_{ds}G_{ds}{}^mC_{ds}T_{ds}{}^mC_{ks}T_{ks}T_k$ | 52 | 3495 |
| 1213045 | 151 | 166 | N/A | N/A | $A_{ks}A_{ks}{}^mC_{ks}G_{ds}A_{ys}{}^mC_{ds}T_{ds}G_{ds}T_{ds}G_{ds}T_{ds}G_{ds}{}^mC_{ds}T_{ks}{}^mC_{ks}T_k$ | 47 | 3571 |
| 1213046 | 152 | 167 | N/A | N/A | $G_{ks}A_{ks}A_{ks}{}^mC_{ds}G_{ys}A_{ds}{}^mC_{ds}T_{ds}G_{ds}T_{ds}G_{ds}T_{ds}G_{ds}{}^mC_{ks}T_{ks}{}^mC_k$ | 77 | 3647 |
| 1213047 | 153 | 168 | N/A | N/A | $A_{ks}G_{ks}A_{ks}A_{ds}C_{ys}G_{ds}A_{ds}{}^mC_{ds}T_{ds}G_{ds}T_{ds}G_{ds}T_{ds}G_{ks}{}^mC_{ks}T_k$ | 42 | 3723 |
| 1213048 | 154 | 169 | N/A | N/A | $G_{ks}A_{ks}G_{ks}A_{ds}A_{ys}{}^mC_{ds}G_{ds}A_{ds}{}^mC_{ds}T_{ds}G_{ds}T_{ds}G_{ds}T_{ks}G_{ks}{}^mC_k$ | 61 | 3799 |
| 1213049 | 155 | 170 | N/A | N/A | $T_{ks}G_{ks}A_{ks}G_{ds}A_{ys}A_{ds}{}^mC_{ds}G_{ds}A_{ds}{}^mC_{ds}T_{ds}G_{ds}T_{ds}G_{ks}T_{ks}G_k$ | 42 | 3875 |
| 1213050 | 156 | 171 | N/A | N/A | $G_{ks}T_{ks}G_{ks}A_{ds}G_{ys}A_{ds}A_{ds}{}^mC_{ds}G_{ds}A_{ds}{}^mC_{ds}T_{ds}G_{ds}T_{ks}G_{ks}T_k$ | 35 | 2424 |
| 1213051 | 157 | 172 | N/A | N/A | $A_{ks}G_{ks}T_{ks}G_{ds}A_{ys}G_{ds}A_{ds}A_{ds}{}^mC_{ds}G_{ds}A_{ds}{}^mC_{ds}T_{ds}G_{ks}T_{ks}G_k$ | 69 | 2502 |

TABLE 86-continued

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (%UTC) | SEQ ID NO |
|---|---|---|---|---|---|---|---|
| 1213052 | 158 | 173 | N/A | N/A | $^mC_{ks}A_{ks}G_{ks}T_{ds}G_{ys}A_{ds}G_{ds}A_{ds}A_{ds}{}^mC_{ds}$ $G_{ds}A_{ds}{}^mC_{ks}T_{ks}G_{k}T_{k}$ | 54 | 2579 |
| 1213053 | 208 | 223 | 3559 | 3574 | $G_{ks}T_{ks}A_{ks}{}^mC_{ds}A_{ys}G_{ds}{}^mC_{ds}T_{ds}G_{ds}{}^mC_{ds}{}^m$ $C_{ds}G_{ds}G_{ds}T_{ks}G_{ks}G_{k}$ | 33 | 4968 |
| 1213054 | 209 | 224 | 3560 | 3575 | $G_{ks}G_{ks}T_{ks}A_{ds}{}^mC_{ys}A_{ds}G_{ds}{}^mC_{ds}T_{ds}G_{ds}{}^m$ $C_{ds}{}^mC_{ds}G_{ds}G_{ks}T_{ks}G_{k}$ | 33 | 4952 |
| 1213055 | 210 | 225 | 3561 | 3576 | $T_{ks}G_{ks}G_{ks}T_{ds}A_{ys}{}^mC_{ds}A_{ds}G_{ds}{}^mC_{ds}T_{ds}G_{ds}$ $^mC_{ds}{}^mC_{ds}G_{ks}G_{ks}T_{k}$ | 26 | 2657 |
| 1213056 | 211 | 226 | 3562 | 3577 | $G_{ks}T_{ks}G_{ks}G_{ds}U_{ys}A_{ds}{}^mC_{ds}A_{ds}G_{ds}{}^mC_{ds}$ $T_{ds}G_{ds}{}^mC_{ds}{}^mC_{ks}G_{ks}G_{k}$ | 34 | 4981 |
| 1213057 | 212 | 227 | 3563 | 3578 | $T_{ks}G_{ks}T_{ks}G_{ds}G_{ys}T_{ds}A_{ds}{}^mC_{ds}A_{ds}G_{ds}{}^mC_{ds}$ $T_{ds}G_{ds}{}^mC_{ks}{}^mC_{ks}G_{k}$ | 78 | 2734 |
| 1213058 | 213 | 228 | 3564 | 3579 | $T_{ks}T_{ks}G_{ks}T_{ds}G_{ys}G_{ds}T_{ds}A_{ds}{}^mC_{ds}A_{ds}G_{ds}$ $^mC_{ds}T_{ds}G_{ks}{}^mC_{ks}{}^mC_{k}$ | 29 | 2811 |
| 1213059 | 214 | 229 | 3565 | 3580 | $T_{ks}T_{ks}T_{ks}G_{ds}U_{ys}G_{ds}G_{ds}T_{ds}A_{ds}{}^mC_{ds}A_{ds}$ $G_{ds}{}^mC_{ds}T_{ks}G_{ks}{}^mC_{k}$ | 44 | 4982 |
| 1213060 | 215 | 230 | 3566 | 3581 | $A_{ks}T_{ks}T_{ks}T_{ds}G_{ys}T_{ds}G_{ds}G_{ds}T_{ds}A_{ds}{}^mC_{ds}$ $A_{ds}G_{ds}{}^mC_{ks}T_{ks}G_{k}$ | 44 | 2963 |
| 1213061 | 216 | 231 | 3567 | 3582 | $^mC_{ks}A_{ks}T_{ks}T_{ds}U_{ys}G_{ds}T_{ds}G_{ds}G_{ds}T_{ds}A_{ds}$ $^mC_{ds}A_{ds}G_{ks}{}^mC_{ks}T_{k}$ | 36 | 4983 |
| 1213062 | 217 | 232 | 3568 | 3583 | $A_{ks}{}^mC_{ks}A_{ks}T_{ds}U_{ys}T_{ds}G_{ds}T_{ds}G_{ds}G_{ds}T_{ds}$ $A_{ds}{}^mC_{ds}A_{ks}G_{ks}{}^mC_{k}$ | 75 | 4984 |
| 1213063 | 218 | 233 | 3569 | 3584 | $T_{ks}A_{ks}{}^mC_{ks}A_{ds}U_{ys}T_{ds}T_{ds}G_{ds}T_{ds}G_{ds}G_{ds}$ $T_{ds}A_{ds}{}^mC_{ks}A_{ks}G_{k}$ | 55 | 4985 |
| 1213064 | 219 | 234 | 3570 | 3585 | $G_{ks}T_{ks}A_{ks}{}^mC_{ds}A_{ys}T_{ds}T_{ds}T_{ds}G_{ds}T_{ds}G_{ds}$ $G_{ds}T_{ds}A_{ks}{}^mC_{ks}A_{k}$ | 38 | 3192 |
| 1213065 | 220 | 235 | 3571 | 3586 | $G_{ks}G_{ks}T_{ks}A_{ds}{}^mC_{ys}A_{ds}T_{ds}T_{ds}T_{ds}G_{ds}T_{ds}$ $G_{ds}G_{ds}T_{ks}A_{ks}{}^mC_{k}$ | 54 | 3269 |
| 1213066 | 221 | 236 | 3572 | 3587 | $G_{ks}G_{ks}G_{ks}T_{ds}A_{ys}{}^mC_{ds}A_{ds}T_{ds}T_{ds}T_{ds}G_{ds}$ $T_{ds}G_{ds}G_{ks}T_{ks}A_{k}$ | 24 | 3345 |
| 1213067 | 222 | 237 | 3573 | 3588 | $T_{ks}G_{ks}G_{ks}G_{ds}U_{ys}A_{ds}{}^mC_{ds}A_{ds}T_{ds}T_{ds}T_{ds}$ $G_{ds}T_{ds}G_{ks}G_{ks}T_{k}$ | 31 | 4986 |
| 1213068 | 223 | 238 | 3574 | 3589 | $G_{ks}T_{ks}G_{ks}G_{ds}G_{ys}T_{ds}A_{ds}{}^mC_{ds}A_{ds}T_{ds}T_{ds}$ $T_{ds}G_{ds}T_{ks}G_{ks}G_{k}$ | 63 | 3497 |
| 1213069 | 1776 | 1791 | 7164 | 7179 | $T_{ks}G_{ks}{}^mC_{ks}A_{ds}G_{ys}G_{ds}G_{ds}T_{ds}G_{ds}A_{ds}G_{ds}$ $^mC_{ds}{}^mC_{ds}G_{ks}G_{ks}{}^mC_{k}$ | 26 | 3299 |
| 1213070 | 1777 | 1792 | 7165 | 7180 | $T_{ks}T_{ks}G_{ks}{}^mC_{ds}A_{ys}G_{ds}G_{ds}G_{ds}T_{ds}G_{ds}A_{ds}$ $G_{ds}{}^mC_{ds}{}^mC_{ks}G_{ks}G_{k}$ | 38 | 3375 |
| 1213071 | 1778 | 1793 | 7166 | 7181 | $^mC_{ks}T_{ks}T_{ks}G_{ds}{}^mC_{ys}A_{ds}G_{ds}G_{ds}G_{ds}T_{ds}G_{ds}$ $A_{ds}G_{ds}{}^mC_{ks}{}^mC_{ks}G_{k}$ | 24 | 4962 |
| 1213072 | 1779 | 1794 | 7167 | 7182 | $^mC_{ks}{}^mC_{ks}T_{ks}T_{ds}G_{ys}{}^mC_{ds}A_{ds}G_{ds}G_{ds}G_{ds}$ $T_{ds}G_{ds}A_{ds}G_{ks}{}^mC_{ks}{}^mC_{k}$ | 41 | 4974 |
| 1213073 | 1780 | 1795 | 7168 | 7183 | $G_{ks}{}^mC_{ks}{}^mC_{ks}T_{ds}U_{ys}G_{ds}{}^mC_{ds}A_{ds}G_{ds}G_{ds}$ $G_{ds}T_{ds}G_{ds}A_{ks}G_{ks}{}^mC_{k}$ | 25 | 4987 |
| 1213074 | 1781 | 1796 | 7169 | 7184 | $T_{ks}G_{ks}{}^mC_{ks}{}^mC_{ds}U_{ys}T_{ds}G_{ds}{}^mC_{ds}A_{ds}G_{ds}$ $G_{ds}G_{ds}T_{ds}G_{ks}A_{ks}G_{k}$ | 16 | 4988 |

TABLE 86-continued

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (%UTC) | SEQ ID NO |
|---|---|---|---|---|---|---|---|
| 1213075 | 1782 | 1797 | 7170 | 7185 | $A_{ks}T_{ks}G_{ks}{}^mC_{ds}C_{ys}T_{ds}T_{ds}G_{ds}{}^mC_{ds}A_{ds}G_{ds}G_{ds}G_{ds}T_{ks}G_{ks}A_k$ | 26 | 4947 |
| 1213076 | 1783 | 1798 | 7171 | 7186 | $G_{ks}A_{ks}T_{ks}G_{ds}C_{ys}{}^mC_{ds}T_{ds}T_{ds}G_{ds}{}^mC_{ds}A_{ds}G_{ds}G_{ds}G_{ks}T_{ks}G_k$ | 23 | 4959 |
| 1213077 | 1784 | 1799 | 7172 | 7187 | $A_{ks}G_{ks}A_{ks}A_{ds}G_{ys}{}^mC_{ds}{}^mC_{ds}T_{ds}T_{ds}G_{ds}{}^mC_{ds}A_{ds}G_{ds}G_{ks}G_{ks}T_k$ | 17 | 4969 |
| 1213078 | 1785 | 1800 | 7173 | 7188 | $A_{ks}T_kG_{ks}A_{ds}U_{ys}G_{ds}{}^mC_{ds}{}^mC_{ds}T_{ds}T_{ds}G_{ds}{}^mC_{ds}A_{ds}G_{ks}G_{ks}G_k$ | 25 | 4989 |
| 1213079 | 1786 | 1801 | 7174 | 7189 | $G_{ks}A_{ks}T_{ks}G_{ds}A_{ys}T_{ds}{}^mC_{ds}{}^mC_{ds}T_{ds}T_{ds}G_{ds}{}^mC_{ds}A_{ks}G_{ks}G_k$ | 24 | 4963 |
| 1213080 | 1787 | 1802 | 7175 | 7190 | $T_{ks}G_{ks}A_{ks}T_{ds}G_{ys}A_{ds}T_{ds}G_{ds}{}^mC_{ds}{}^mC_{ds}T_{ds}Td_sG_{ds}{}^mC_{ks}A_{ks}G_k$ | 34 | 4975 |
| 1213081 | 1788 | 1803 | 7176 | 7191 | ${}^mC_{ks}T_{ks}G_{ks}A_{ds}U_{ys}G_{ds}A_{ds}T_{ds}G_{ds}{}^mC_{ds}{}^mC_{ds}T_{ds}T_{ds}G_{ks}{}^mC_{ks}A_k$ | 19 | 4990 |
| 1213082 | 1789 | 1804 | 7177 | 7192 | $G_{ks}{}^mC_{ks}T_{ks}G_{ds}A_{ys}T_{ds}G_{ds}A_{ds}T_{ds}G_{ds}{}^mC_{ds}{}^mC_{ds}T_{ds}T_{ks}G_{ks}{}^mC_k$ | 50 | 3755 |
| 1213083 | 1790 | 1805 | 7178 | 7193 | $A_{ks}G_{ks}{}^mC_{ks}T_{ds}G_{ys}A_{ds}T_{ds}G_{ds}A_{ds}T_{ds}G_{ds}{}^mC_{ds}{}^mC_{ds}T_{ks}T_{ks}G_k$ | 59 | 3831 |
| 1213084 | 1791 | 1806 | 7179 | 7194 | ${}^mC_{ks}A_{ks}G_{ks}{}^mC_{ds}U_{ys}G_{ds}A_{ds}T_{ds}G_{ds}A_{ds}T_{ds}G_{ds}{}^mC_{ds}{}^mC_{ks}T_{ks}T_k$ | 35 | 4991 |
| 1213085 | 1792 | 1807 | 7180 | 7195 | ${}^mC_{ks}{}^mC_{ks}A_{ks}G_{ds}C_{ys}T_{ds}G_{ds}A_{ds}T_{ds}G_{ds}A_{ds}T_{ds}G_{ds}{}^mC_{ks}{}^mC_{ks}T_k$ | 31 | 4970 |
| 1213086 | 1793 | 1808 | 7181 | 7196 | ${}^mC_{ks}{}^mC_{ks}{}^mC_{ks}A_{ds}G_{ys}{}^mC_{ds}T_{ds}G_{ds}A_{ds}T_{ds}G_{ds}A_{ds}T_{ds}G_{ks}{}^mC_{ks}{}^mC_k$ | 39 | 4953 |
| 1213087 | 1892 | 1907 | 7280 | 7295 | ${}^mC_{ks}{}^mC_{ks}{}^mC_{ks}T_{ds}G_{ys}A_{ds}G_{ds}{}^mC_{ds}A_{ds}A_{ds}T_{ds}{}^mC_{ds}A_{ds}G_{ks}G_{ks}A_k$ | 27 | 3530 |
| 1213088 | 1893 | 1908 | 7281 | 7296 | $T_{ks}{}^mC_{ks}{}^mC_{ks}{}^mC_{ds}U_{ys}G_{ds}A_{ds}G_{ds}{}^mC_{ds}A_{ds}A_{ds}T_{ds}{}^mC_{ds}A_{ks}G_{ks}G_k$ | 43 | 4992 |
| 1213089 | 1894 | 1909 | 7282 | 7297 | $G_{ks}T_{ks}{}^mC_{ks}{}^mC_{ds}C_{ys}T_{ds}G_{ds}A_{ds}G_{ds}{}^mC_{ds}A_{ds}A_{ds}T_{ds}{}^mC_{ks}A_{ks}G_k$ | 22 | 3682 |
| 1213090 | 1895 | 1910 | 7283 | 7298 | $A_{ks}G_{ks}T_{ks}{}^mC_{ds}C_{ys}{}^mC_{ds}T_{ds}G_{ds}A_{ds}G_{ds}{}^mC_{ds}A_{ds}A_{ds}T_{ks}{}^mC_{ks}A_k$ | 29 | 3758 |
| 1213091 | 1896 | 1911 | 7284 | 7299 | $G_{ks}A_{ks}G_{ks}T_{ds}C_{ys}{}^mC_{ds}{}^mC_{ds}T_{ds}G_{ds}A_{ds}G_{ds}{}^mC_{ds}A_{ds}A_{ks}T_{ks}{}^mC_k$ | 33 | 3834 |
| 1213092 | 1897 | 1912 | 7285 | 7300 | $T_{ks}G_{ks}A_{ks}G_{ds}U_{ys}{}^mC_{ds}{}^mC_{ds}{}^mC_{ds}T_{ds}G_{ds}A_{ds}G_{ds}{}^mC_{ds}A_{ks}A_{ks}T_k$ | 38 | 4993 |

TABLE 87

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (%UTC) | SEQ ID NO |
|---|---|---|---|---|---|---|---|
| 1128769 | 153 | 168 | N/A | N/A | $A_{ks}G_{ks}A_{ks}A_{ds}{}^mC_{ds}G_{ds}A_{ds}{}^mC_{ds}T_{ds}G_{ds}T_{ds}G_{ds}T_{ds}G_{ks}{}^mC_{ks}T_k$ | 63 | 3723 |

TABLE 87-continued

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (%UTC) | SEQ ID NO |
|---|---|---|---|---|---|---|---|
| 1128802 | 218 | 233 | 3569 | 3584 | $T_{ks}A_{ks}{}^mC_{ks}A_{ds}T_{ds}T_{ds}T_{ds}G_{ds}T_{ds}G_{ds}G_{ds}T_{ds}A_{ds}{}^mC_{ks}A_{ks}G_k$ | 90 | 2426 |
| 1128870 | 470 | 485 | 4415 | 4430 | $T_{ks}G_{ks}T_{ks}G_{ds}G_{ds}A_{ds}A_{ds}A_{ds}A_{ds}{}^mC_{ds}{}^mC_{ds}G_{ds}G_{ks}A_{ks}G_k$ | 44 | 3728 |
| 1129409 | 1788 | 1803 | 7176 | 7191 | ${}^mC_{ks}T_{ks}G_{ks}A_{ds}T_{ds}G_{ds}A_{ds}T_{ds}G_{ds}{}^mC_{ds}{}^mC_{ds}T_{ds}T_{ds}G_{ks}{}^mC_{ks}A_k$ | 7 | 3679 |
| 1129486 | 1922 | 1937 | 7310 | 7325 | $T_{ks}G_{ks}{}^mC_{ks}G_{ds}G_{ds}A_{ds}A_{ds}T_{ds}{}^mC_{ds}A_{ds}{}^mC_{ds}{}^mC_{ds}A_{ds}A_{ks}G_{ks}G_k$ | 11 | 3455 |
| 1129489 | 1925 | 1940 | 7313 | 7328 | ${}^mC_{ks}A_{ks}{}^mC_{ks}T_{ds}G_{ds}{}^mC_{ds}G_{ds}G_{ds}A_{ds}A_{ds}T_{ds}{}^mC_{ds}A_{ds}{}^mC_{ks}{}^mC_{ks}A_k$ | 21 | 3683 |
| 1129491 | 1927 | 1942 | 7315 | 7330 | ${}^mC_{ks}T_{ks}{}^mC_{ks}A_{ds}C_{ds}T_{ds}G_{ds}{}^mC_{ds}G_{ds}G_{ds}A_{ds}A_{ds}T_{ds}{}^mC_{ks}A_{ks}{}^mC_k$ | 54 | 3835 |
| 1129531 | 2009 | 2024 | 7397 | 7412 | $G_{ks}A_{ks}G_{ks}T_{ds}T_{ds}{}^mC_{ds}{}^mC_{ds}T_{ds}G_{ds}{}^mC_{ds}G_{ds}{}^mC_{ds}{}^mC_{ds}A_{ks}T_{ks}{}^mC_k$ | 9 | 3837 |
| 1129532 | 2010 | 2025 | 7398 | 7413 | $T_{ks}G_{ks}A_{ks}G_{ds}T_{ds}T_{ds}{}^mC_{ds}{}^mC_{ds}T_{ds}G_{ds}{}^mC_{ds}G_{ds}{}^mC_{ds}{}^mC_{ks}A_{ks}T_k$ | 16 | 3913 |
| 1129540 | 2019 | 2034 | 7407 | 7422 | $G_{ks}{}^mC_{ks}A_{ks}{}^mC_{ds}T_{ds}T_{ds}A_{ds}T_{ds}T_{ds}G_{ds}A_{ds}G_{ds}T_{ks}T_{ks}{}^mC_k$ | 19 | 3000 |
| 1129572 | N/A | N/A | 186 | 201 | $G_{ks}G_{ks}A_{ks}{}^mC_{ds}{}^mC_{ds}{}^mC_{ds}A_{ds}{}^mC_{ds}A_{ds}G_{ds}G_{ds}T_{ds}{}^mC_{ds}A_{ks}T_{ks}G_k$ | 47 | 3915 |
| 1129857 | N/A | N/A | 3881 | 3896 | $G_{ks}T_{ks}A_{ks}A_{ds}T_{ds}G_{ds}G_{ds}G_{ds}G_{ds}C_{ds}G_{ds}G_{ds}G_{ds}A_{ks}G_{ks}G_k$ | 48 | 2787 |
| 1129938 | N/A | N/A | 4635 | 4650 | $A_{ks}{}^mC_{ks}G_{ks}{}^mC_{ds}A_{ds}G_{ds}T_{ds}G_{ds}A_{ds}G_{ds}{}^mC_{ds}{}^mC_{ds}A_{ds}{}^mC_{ks}{}^mC_{ks}{}^mC_k$ | 62 | 2868 |
| 1129948 | N/A | N/A | 4840 | 4855 | $A_{ks}T_{ks}{}^mC_{ks}T_{ds}G_{ds}{}^mC_{ds}T_{ds}T_{ds}T_{ds}{}^mC_{ds}{}^mC_{ds}G_{ds}{}^mC_{ds}A_{ks}{}^mC_{ks}T_k$ | 34 | 3630 |
| 1129949 | N/A | N/A | 4844 | 4859 | $T_{ks}{}^mC_{ks}T_{ks}{}^mC_{ds}A_{ds}A_{ds}{}^mC_{ds}T_{ds}G_{ds}{}^mC_{ds}T_{ds}T_{ds}T_{ds}{}^mC_{ks}{}^mC_{ks}G_k$ | 41 | 3706 |
| 1130010 | N/A | N/A | 5752 | 5767 | $A_{ks}{}^mC_{ks}G_{ks}G_{ds}A_{ds}G_{ds}G_{ds}G_{ds}A_{ds}G_{ds}{}^mC_{ds}{}^mC_{ds}G_{ds}{}^mC_{ks}G_{ks}{}^mC_k$ | 29 | 3785 |
| 1130142 | N/A | N/A | 6579 | 6594 | ${}^mC_{ks}G_{ks}T_{ks}{}^mC_{ds}{}^mC_{ds}T_{ds}A_{ds}G_{ds}T_{ds}T_{ds}G_{ds}G_{ds}{}^mC_{ds}{}^mC_{ks}T_{ks}T_k$ | 32 | 3177 |
| 1130215 | N/A | N/A | 7015 | 7030 | $C_{ks}A_{ks}{}^mC_{ks}{}^mC_{ds}T_{ds}G_{ds}G_{ds}{}^mC_{ds}A_{ds}{}^mC_{ds}G_{ds}{}^mC_{ds}A_{ds}T_{ks}{}^mC_{ks}G_k$ | 41† | 2651 |
| 1130251 | N/A | N/A | 7111 | 7126 | $G_{ks}G_{ks}A_{ks}A_{ds}T_{ds}{}^mC_{ds}A_{ds}{}^mC_{ds}{}^mC_{ds}{}^mC_{ds}T_{ds}G_{ds}G_{ds}G_{ks}T_{ks}{}^mC_k$ | 30† | 3873 |
| 1130252 | N/A | N/A | 7112 | 7127 | ${}^mC_{ks}G_{ks}G_{ks}A_{ds}A_{ds}T_{ds}{}^mC_{ds}A_{ds}{}^mC_{ds}{}^mC_{ds}{}^mC_{ds}T_{ds}G_{ds}G_{ks}G_{ks}T_k$ | 15† | 3949 |
| 1213093 | 1898 | 1913 | 7286 | 7301 | $A_{ks}T_{ks}G_{ks}A_{ds}G_{ys}T_{ds}{}^mC_{ds}{}^mC_{ds}{}^mC_{ds}T_{ds}G_{ds}A_{ds}G_{ds}{}^mC_{ks}A_{ks}A_k$ | 42 | 2460 |
| 1213094 | 1899 | 1914 | 7287 | 7302 | $G_{ks}A_{ks}T_{ks}G_{ds}A_{ys}G_{ds}T_{ds}{}^mC_{ds}{}^mC_{ds}{}^mC_{ds}T_{ds}G_{ds}A_{ds}G_{ks}{}^mC_{ks}A_k$ | 18 | 2537 |
| 1213095 | 1900 | 1915 | 7288 | 7303 | $A_{ks}G_{ks}A_{ks}T_{ds}G_{ys}A_{ds}G_{ds}T_{ds}{}^mC_{ds}{}^mC_{ds}{}^mC_{ds}T_{ds}G_{ds}A_{ks}G_{ks}{}^mC_k$ | 13 | 2614 |
| 1213096 | 1901 | 1916 | 7289 | 7304 | $A_{ks}A_{ks}G_{ks}A_{ds}U_{ys}G_{ds}A_{ds}G_{ds}T_{ds}{}^mC_{ds}{}^mC_{ds}{}^mC_{ds}T_{ds}G_{ks}A_{ks}G_k$ | 28 | 4994 |

TABLE 87-continued

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (%UTC) | SEQ ID NO |
|---|---|---|---|---|---|---|---|
| 1213097 | 1902 | 1917 | 7290 | 7305 | $A_{ks}A_{ks}A_{ks}G_{ds}A_{ys}T_{ds}G_{ds}A_{ds}G_{ds}T_{ds}{}^{m}C_{ds}{}^{m}C_{ds}{}^{m}C_{ds}T_{ks}G_{ks}A_{k}$ | 19 | 2768 |
| 1213098 | 1903 | 1918 | 7291 | 7306 | $G_{ks}A_{ks}A_{ks}A_{ds}G_{ys}A_{ds}T_{ds}G_{ds}A_{ds}G_{ds}T_{ds}{}^{m}C_{ds}{}^{m}C_{ds}{}^{m}C_{ks}T_{ks}G_{k}$ | 36 | 2845 |
| 1213099 | 1904 | 1919 | 7292 | 7307 | $G_{ks}G_{ks}A_{ks}A_{ds}A_{ys}G_{ds}A_{ds}T_{ds}G_{ds}A_{ds}G_{ds}T_{ds}{}^{m}C_{ds}{}^{m}C_{ks}{}^{m}C_{ks}T_{k}$ | 25 | 2921 |
| 1213100 | 1905 | 1920 | 7293 | 7308 | $G_{ks}G_{ks}G_{ks}A_{ds}A_{ys}A_{ds}G_{ds}A_{ds}T_{ds}G_{ds}A_{ds}G_{ds}T_{ds}{}^{m}C_{ks}{}^{m}C_{ks}{}^{m}C_{k}$ | 26 | 2997 |
| 1213101 | 1906 | 1921 | 7294 | 7309 | $A_{ks}G_{ks}G_{ks}G_{ds}A_{ys}A_{ds}A_{ds}G_{ds}A_{ds}T_{ds}G_{ds}A_{ds}G_{ds}T_{ks}{}^{m}C_{ks}{}^{m}C_{k}$ | 24 | 3073 |
| 1213102 | 1914 | 1929 | 7302 | 7317 | ${}^{m}C_{ks}A_{ks}{}^{m}C_{ks}{}^{m}C_{ds}A_{ys}A_{ds}G_{ds}G_{ds}A_{ds}G_{ds}G_{ds}G_{ds}A_{ds}A_{ks}A_{ks}G_{k}$ | 34 | 4954 |
| 1213103 | 1915 | 1930 | 7303 | 7318 | $T_{ks}{}^{m}C_{ks}A_{ks}{}^{m}C_{ds}C_{ys}A_{ds}A_{ds}G_{ds}G_{ds}A_{ds}G_{ds}G_{ds}G_{ds}A_{ks}A_{ks}A_{k}$ | 41 | 4948 |
| 1213104 | 1916 | 1931 | 7304 | 7319 | $A_{ks}T_{ks}{}^{m}C_{ks}A_{ds}C_{ys}{}^{m}C_{ds}A_{ds}A_{ds}G_{ds}G_{ds}A_{ds}G_{ds}G_{ds}G_{ks}A_{ks}A_{k}$ | 41 | 4966 |
| 1213105 | 1917 | 1932 | 7305 | 7320 | $A_{ks}A_{ks}T_{ks}{}^{m}C_{ds}A_{ys}{}^{m}C_{ds}{}^{m}C_{ds}A_{ds}A_{ds}G_{ds}G_{ds}A_{ds}G_{ds}G_{ks}G_{ks}A_{k}$ | 21 | 4956 |
| 1213106 | 1918 | 1933 | 7306 | 7321 | $G_{ks}A_{ks}A_{ks}T_{ds}C_{ys}A_{ds}{}^{m}C_{ds}{}^{m}C_{ds}A_{ds}A_{ds}G_{ds}G_{ds}A_{ds}G_{ks}G_{ks}G_{k}$ | 23 | 4965 |
| 1213107 | 1919 | 1934 | 7307 | 7322 | $G_{ks}G_{ks}A_{ks}A_{ds}U_{ys}{}^{m}C_{ds}A_{ds}{}^{m}C_{ds}{}^{m}C_{ds}A_{ds}A_{ds}G_{ds}G_{ds}A_{ks}G_{ks}G_{k}$ | 18 | 4995 |
| 1213108 | 1920 | 1935 | 7308 | 7323 | ${}^{m}C_{ks}G_{ks}G_{ks}A_{ds}A_{ys}T_{ds}{}^{m}C_{ds}A_{ds}{}^{m}C_{ds}{}^{m}C_{ds}A_{ds}A_{ds}G_{ds}G_{ks}A_{ks}G_{k}$ | 28 | 3303 |
| 1213109 | 1921 | 1936 | 7309 | 7324 | $G_{ks}{}^{m}C_{ks}G_{ks}G_{ds}A_{ys}A_{ds}T_{ds}{}^{m}C_{ds}A_{ds}{}^{m}C_{ds}{}^{m}C_{ds}A_{ds}A_{ds}G_{ks}G_{ks}A_{k}$ | 37 | 3379 |
| 1213110 | 1922 | 1937 | 7310 | 7325 | $T_{ks}G_{ks}{}^{m}C_{ks}G_{ds}G_{ys}A_{ds}A_{ds}T_{ds}{}^{m}C_{ds}A_{ds}{}^{m}C_{ds}{}^{m}C_{ds}A_{ds}A_{ks}G_{ks}G_{k}$ | 20 | 3455 |
| 1213111 | 1923 | 1938 | 7311 | 7326 | ${}^{m}C_{ks}T_{ks}G_{ks}{}^{m}C_{ds}G_{ys}G_{ds}A_{ds}A_{ds}T_{ds}C_{ds}A_{ds}{}^{m}C_{ds}{}^{m}C_{ds}A_{ks}A_{ks}G_{k}$ | 12 | 3531 |
| 1213112 | 1924 | 1939 | 7312 | 7327 | $A_{ks}{}^{m}C_{ks}T_{ks}G_{ds}C_{ys}G_{ds}G_{ds}A_{ds}A_{ds}T_{ds}{}^{m}C_{ds}A_{ds}{}^{m}C_{ds}{}^{m}C_{ks}A_{ks}A_{k}$ | 20 | 3607 |
| 1213113 | 1925 | 1940 | 7313 | 7328 | ${}^{m}C_{ks}A_{ks}{}^{m}C_{ks}T_{ds}G_{ys}{}^{m}C_{ds}G_{ds}G_{ds}A_{ds}A_{ds}T_{ds}{}^{m}C_{ds}A_{ds}{}^{m}C_{ks}{}^{m}C_{ks}A_{k}$ | 29 | 3683 |
| 1213114 | 1926 | 1941 | 7314 | 7329 | $T_{ks}{}^{m}C_{ks}A_{ks}{}^{m}C_{ds}U_{ys}G_{ds}{}^{m}C_{ds}G_{ds}G_{ds}A_{ds}A_{ds}T_{ds}{}^{m}C_{ds}A_{ks}{}^{m}C_{ks}{}^{m}C_{k}$ | 30 | 4996 |
| 1213115 | 1927 | 1942 | 7315 | 7330 | ${}^{m}C_{ks}T_{ks}{}^{m}C_{ks}A_{ds}C_{ys}T_{ds}G_{ds}{}^{m}C_{ds}G_{ds}G_{ds}A_{ds}A_{ds}T_{ds}{}^{m}C_{ks}A_{ks}{}^{m}C_{k}$ | 18 | 3835 |
| 1213116 | 1928 | 1943 | 7316 | 7331 | $T_{ks}{}^{m}C_{ks}T_{ks}{}^{m}C_{ds}A_{ys}{}^{m}C_{ds}T_{ds}G_{ds}{}^{m}C_{ds}G_{ds}G_{ds}A_{ds}A_{ds}T_{ks}{}^{m}C_{ks}A_{k}$ | 28 | 3911 |
| 1213117 | 1929 | 1944 | 7317 | 7332 | ${}^{m}C_{ks}T_{ks}{}^{m}C_{ks}T_{ds}C_{ys}A_{ds}{}^{m}C_{ds}T_{ds}G_{ds}{}^{m}C_{ds}G_{ds}G_{ds}A_{ds}A_{ks}T_{ks}{}^{m}C_{k}$ | 26 | 4971 |
| 1213118 | 1930 | 1945 | 7318 | 7333 | $T_{ks}{}^{m}C_{ks}T_{ks}{}^{m}C_{ds}U_{ys}{}^{m}C_{ds}A_{ds}{}^{m}C_{ds}T_{ds}G_{ds}{}^{m}C_{ds}G_{ds}G_{ds}A_{ks}A_{ks}T_{k}$ | 19 | 4997 |
| 1213119 | 1931 | 1946 | 7319 | 7334 | ${}^{m}C_{ks}T_{ks}{}^{m}C_{ks}T_{ds}C_{ys}T_{ds}{}^{m}C_{ds}A_{ds}{}^{m}C_{ds}T_{ds}G_{ds}{}^{m}C_{ds}G_{ds}G_{ks}A_{ks}A_{k}$ | 52 | 2461 |

TABLE 87-continued

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (%UTC) | SEQ ID NO |
|---|---|---|---|---|---|---|---|
| 1213120 | 1932 | 1947 | 7320 | 7335 | $A_{ks}{}^mC_{ks}T_{ks}{}^mC_{ds}U_{ys}{}^mC_{ds}T_{ds}{}^mC_{ds}A_{ds}{}^mC_{ds}T_{ds}G_{ds}{}^mC_{ds}G_{ks}G_{ks}A_k$ | 10 | 4998 |
| 1213121 | 1933 | 1948 | 7321 | 7336 | ${}^mC_{ks}A_{ks}{}^mC_{ks}T_{ds}C_{ys}T_{ds}{}^mC_{ds}T_{ds}{}^mC_{ds}A_{ds}{}^mC_{ds}T_{ds}G_{ds}{}^mC_{ks}G_{ks}G_k$ | 34 | 4957 |
| 1213122 | 1934 | 1949 | 7322 | 7337 | ${}^mC_{ks}{}^mC_{ks}A_{ks}{}^mC_{ds}U_{ys}{}^mC_{ds}T_{ds}{}^mC_{ds}T_{ds}{}^mC_{ds}A_{ds}{}^mC_{ds}T_{ds}G_{ks}{}^mC_{ks}G_k$ | 19 | 4999 |
| 1213123 | 1935 | 1950 | 7323 | 7338 | $G_{ks}{}^mC_{ks}{}^mC_{ks}A_{ds}C_{ys}T_{ds}{}^mC_{ds}T_{ds}{}^mC_{ds}T_{ds}{}^mC_{ds}A_{ds}{}^mC_{ds}A_{ks}G_{ks}{}^mC_k$ | 33 | 4967 |
| 1213124 | 1936 | 1951 | 7324 | 7339 | $A_{ks}G_{ks}{}^mC_{ks}{}^mC_{ds}A_{ys}{}^mC_{ds}T_{ds}{}^mC_{ds}T_{ds}{}^mC_{ds}T_{ds}{}^mC_{ds}A_{ds}{}^mC_{ks}T_{ks}G_k$ | 14 | 4961 |
| 1213125 | 1937 | 1952 | 7325 | 7340 | ${}^mC_{ks}A_{ks}G_{ks}{}^mC_{ds}C_{ys}A_{ds}{}^mC_{ds}T_{ds}{}^mC_{ds}T_{ds}{}^mC_{ds}T_{ds}{}^mC_{ds}A_{ds}{}^mC_{ks}T_k$ | 42 | 4972 |
| 1213126 | 2000 | 2015 | 7388 | 7403 | ${}^mC_{ks}G_{ks}{}^mC_{ks}{}^mC_{ds}A_{ys}T_{ds}{}^mC_{ds}{}^mC_{ds}T_{ds}G_{ds}G_{ds}{}^mC_{ds}G_{ds}{}^mC_{ks}G_{ks}G_k$ | 53 | 3228 |
| 1213127 | 2001 | 2016 | 7389 | 7404 | $G_{ks}{}^mC_{ks}G_{ks}{}^mC_{ds}C_{ys}A_{ds}T_{ds}{}^mC_{ds}{}^mC_{ds}T_{ds}G_{ds}G_{ds}{}^mC_{ds}G_{ks}{}^mC_{ks}G_k$ | 34 | 4964 |
| 1213128 | 2002 | 2017 | 7390 | 7405 | $T_{ks}G_{ks}{}^mC_{ks}G_{ds}C_{ys}{}^mC_{ds}A_{ds}T_{ds}{}^mC_{ds}{}^mC_{ds}T_{ds}G_{ds}G_{ds}{}^mC_{ks}G_{ks}{}^mC_k$ | 61 | 3305 |
| 1213129 | 2003 | 2018 | 7391 | 7406 | ${}^mC_{ks}T_{ks}G_{ks}{}^mC_{ds}G_{ys}{}^mC_{ds}{}^mC_{ds}A_{ds}T_{ds}{}^mC_{ds}{}^mC_{ds}T_{ds}G_{ds}G_{ks}{}^mC_{ks}G_k$ | 114 | 3381 |
| 1213130 | 2004 | 2019 | 7392 | 7407 | ${}^mC_{ks}{}^mC_{ks}T_{ks}G_{ds}C_{ys}G_{ds}{}^mC_{ds}{}^mC_{ds}A_{ds}T_{ds}{}^mC_{ds}{}^mC_{ds}T_{ds}G_{ks}G_{ks}{}^mC_k$ | 24 | 3457 |
| 1213131 | 2005 | 2020 | 7393 | 7408 | $T_{ks}{}^mC_{ks}{}^mC_{ks}T_{ds}G_{ys}{}^mC_{ds}G_{ds}{}^mC_{ds}{}^mC_{ds}A_{ds}T_{ds}{}^mC_{ds}{}^mC_{ds}T_{ks}G_{ks}G_k$ | 35 | 3533 |
| 1213132 | 2006 | 2021 | 7394 | 7409 | $T_{ks}T_{ks}{}^mC_{ks}{}^mC_{ds}C_{ys}G_{ds}{}^mC_{ds}G_{ds}{}^mC_{ds}{}^mC_{ds}A_{ds}T_{ds}{}^mC_{ds}{}^mC_{ks}T_{ks}G_k$ | 29 | 5000 |
| 1213133 | 2007 | 2022 | 7395 | 7410 | $G_{ks}T_{ks}T_{ks}{}^mC_{ds}C_{ys}T_{ds}G_{ds}{}^mC_{ds}G_{ds}{}^mC_{ds}{}^mC_{ds}A_{ds}T_{ds}{}^mC_{ks}{}^mC_{ks}T_k$ | 33 | 3685 |
| 1213134 | 2008 | 2023 | 7396 | 7411 | $A_{ks}G_{ks}T_{ks}T_{ds}C_{ys}{}^mC_{ds}T_{ds}G_{ds}{}^mC_{ds}G_{ds}{}^mC_{ds}{}^mC_{ds}A_{ds}T_{ks}{}^mC_{ks}{}^mC_k$ | 33 | 3761 |
| 1213135 | 2009 | 2024 | 7397 | 7412 | $G_{ks}A_kGG_{ks}T_{ds}U_{ys}{}^mC_{ds}{}^mC_{ds}T_{ds}G_{ds}{}^mC_{ds}G_{ds}{}^mC_{ds}{}^mC_{ds}A_{ks}T_{ks}{}^mC_k$ | 9 | 5001 |
| 1213136 | 2010 | 2025 | 7398 | 7413 | $T_{ks}G_{ks}A_{ks}G_{ds}U_{ys}T_{ds}{}^mC_{ds}{}^mC_{ds}T_{ds}G_{ds}{}^mC_{ds}G_{ds}{}^mC_{ds}{}^mC_{ks}A_{ks}T_k$ | 20 | 5002 |
| 1213137 | 2011 | 2026 | 7399 | 7414 | $T_{ks}T_{ks}G_{ks}A_{ds}G_{ys}T_{ds}T_{ds}{}^mC_{ds}{}^mC_{ds}T_{ds}G_{ds}{}^mC_{ds}G_{ds}{}^mC_{ks}{}^mC_{ks}A_k$ | 17 | 2463 |
| 1213138 | 2012 | 2027 | 7400 | 7415 | $A_{ks}T_{ks}T_{ks}G_{ds}A_{ys}G_{ds}T_{ds}T_{ds}{}^mC_{ds}{}^mC_{ds}T_{ds}G_{ds}{}^mC_{ds}G_{ks}{}^mC_{ks}{}^mC_k$ | 17 | 2540 |
| 1213139 | 2013 | 2028 | 7401 | 7416 | $T_{ks}A_{ks}T_{ks}T_{ds}G_{ys}A_{ds}G_{ds}T_{ds}T_{ds}{}^mC_{ds}{}^mC_{ds}T_{ds}G_{ds}{}^mC_{ks}G_{ks}{}^mC_k$ | 26 | 2617 |
| 1213140 | 2014 | 2029 | 7402 | 7417 | $T_{ks}T_{ks}A_{ks}T_{ds}U_{ys}G_{ds}A_{ds}G_{ds}T_{ds}T_{ds}{}^mC_{ds}{}^mC_{ds}T_{ds}G_{ks}{}^mC_{ks}G_k$ | 25 | 5003 |
| 1213141 | 2016 | 2031 | 7404 | 7419 | ${}^mC_{ks}T_{ks}T_{ks}T_{ds}A_{ys}T_{ds}T_{ds}G_{ds}A_{ds}G_{ds}T_{ds}T_{ds}{}^mC_{ds}{}^mC_{ks}T_{ks}G_k$ | 22 | 2771 |
| 1213142 | 2017 | 2032 | 7405 | 7420 | $A_{ks}{}^mC_{ks}T_{ks}T_{ds}U_{ys}A_{ds}T_{ds}T_{ds}G_{ds}A_{ds}G_{ds}T_{ds}T_{ds}{}^mC_{ks}{}^mC_{ks}T_k$ | 30 | 5004 |

TABLE 87-continued

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (%UTC) | SEQ ID NO |
|---|---|---|---|---|---|---|---|
| 1213143 | 2018 | 2033 | 7406 | 7421 | $^mC_{ks}A_{ks}{}^mC_{ks}T_{ds}U_{ys}T_{ds}A_{ds}T_{ds}T_{ds}G_{ds}A_{ds}G_{ds}T_{ds}T_{ks}{}^mC_{ks}{}^mC_k$ | 25 | 5005 |
| 1213144 | 2019 | 2034 | 7407 | 7422 | $G_{ks}{}^mC_{ks}A_{ks}{}^mC_{ds}U_{ys}T_{ds}A_{ds}T_{ds}T_{ds}G_{ds}A_{ds}G_{ds}T_{ks}T_{ks}{}^mC_k$ | 10 | 5006 |
| 1213145 | 2020 | 2035 | 7408 | 7423 | $A_{ks}G_{ks}{}^mC_{ks}A_{ds}C_{ys}T_{ds}T_{ds}T_{ds}A_{ds}T_{ds}T_{ds}G_{ds}A_{ds}G_{ks}T_{ks}T_k$ | 20 | 3076 |
| 1213146 | 2021 | 2036 | 7409 | 7424 | $A_{ks}A_{ks}G_{ks}{}^mC_{ds}A_{ys}{}^mC_{ds}T_{ds}T_{ds}T_{ds}A_{ds}T_{ds}T_{ds}G_{ds}A_{ks}G_{ks}T_k$ | 11 | 3147 |
| 1213147 | 2022 | 2037 | 7410 | 7425 | $A_{ks}A_{ks}A_{ks}G_{ds}C_{ys}A_{ds}{}^mC_{ds}T_{ds}T_{ds}T_{ds}A_{ds}T_{ds}T_{ds}G_{ks}A_{ks}G_k$ | 15 | 3229 |
| 1213148 | 2023 | 2038 | 7411 | 7426 | $^mC_{ks}A_{ks}A_{ks}A_{ds}G_{ys}{}^mC_{ds}A_{ds}{}^mC_{ds}T_{ds}T_{ds}T_{ds}A_{ds}T_{ds}T_{ks}G_{ks}A_k$ | 34 | 3306 |
| 1213149 | 2024 | 2039 | 7412 | 7427 | $T_{ks}{}^mC_{ks}A_{ks}A_{ds}A_{ys}G_{ds}{}^mC_{ds}A_{ds}{}^mC_{ds}T_{ds}T_{ds}T_{ds}A_{ds}T_{ks}T_{ks}G_k$ | 35 | 3382 |
| 1213150 | 2031 | 2046 | 7419 | 7434 | $A_{ks}G_{ks}{}^mC_{ks}A_{ds}U_{ys}T_{ds}T_{ds}T_{ds}{}^mC_{ds}A_{ds}A_{ds}A_{ds}G_{ds}{}^mC_{ks}A_{ks}{}^mC_k$ | 41 | 5007 |
| 1213151 | 2033 | 2048 | 7421 | 7436 | $T_{ks}{}^mC_{ks}A_{ks}G_{ds}C_{ys}A_{ds}T_{ds}T_{ds}T_{ds}T_{ds}{}^mC_{ds}A_{ds}A_{ds}A_{ks}G_{ks}{}^mC_k$ | 23 | 3534 |

TABLE 88

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Chemistry notation (5' to 3') | FXII (%UTC) | SEQ ID NO |
|---|---|---|---|---|---|---|---|
| 1128769 | 153 | 168 | N/A | N/A | $A_{ks}G_{ks}A_{ks}A_{ds}{}^mC_{ds}G_{ds}A_{ds}C_{ds}T_{ds}G_{ds}T_{ds}G_{ds}T_{ds}G_{ks}{}^mC_{ks}T_k$ | 41 | 3723 |
| 1128802 | 218 | 233 | 3569 | 3584 | $T_{ks}A_{ks}{}^mC_{ks}A_{ds}T_{ds}T_{ds}T_{ds}G_{ds}T_{ds}G_{ds}G_{ds}T_{ds}A_{ds}{}^mC_{ks}A_{ks}G_k$ | N/A | 2426 |
| 1128870 | 470 | 485 | 4415 | 4430 | $T_{ks}G_{ks}T_{ks}G_{ds}G_{ds}A_{ds}A_{ds}A_{ds}A_{ds}A_{ds}{}^mC_{ds}{}^mC_{ds}G_{ds}G_{ks}A_{ks}G_k$ | 31 | 3728 |
| 1129491 | 1927 | 1942 | 7315 | 7330 | $^mC_{ks}T_{ks}{}^mC_{ks}A_{ds}{}^mC_{ds}T_{ds}G_{ds}{}^mC_{ds}G_{ds}G_{ds}A_{ds}A_{ds}T_{ds}{}^mC_{ks}A_{ks}{}^mC_k$ | 16 | 3835 |
| 1129510 | 1984 | 1999 | 7372 | 7387 | $A_{ks}G_{ks}{}^mC_{ks}T_{ds}G_{ds}G_{ds}{}^mC_{ds}{}^mC_{ds}G_{ds}G_{ds}{}^mC_{ds}A_{ds}{}^mC_{ds}T_{ds}G_{ks}G_{ks}G_k$ | 29 | 3760 |
| 1129530 | 2008 | 2023 | 7396 | 7411 | $A_{ks}G_{ks}T_{ks}T_{ds}{}^mC_{ds}{}^mC_{ds}T_{ds}G_{ds}G_{ds}{}^mC_{ds}G_{ds}{}^mC_{ds}{}^mC_{ds}A_{ds}T_{ks}{}^mC_{ks}{}^mC_k$ | 80 | 3761 |
| 1129531 | 2009 | 2024 | 7397 | 7412 | $G_{ks}A_{ks}G_{ks}T_{ds}T_{ds}{}^mC_{ds}{}^mC_{ds}T_{ds}G_{ds}G_{ds}{}^mC_{ds}G_{ds}{}^mC_{ds}{}^mC_{ds}A_{ks}T_{ks}{}^mC_k$ | 29 | 3837 |
| 1129532 | 2010 | 2025 | 7398 | 7413 | $T_{ks}G_{ks}A_{ks}G_{ds}T_{ds}T_{ds}{}^mC_{ds}{}^mC_{ds}T_{ds}G_{ds}{}^mC_{ds}G_{ds}{}^mC_{ds}{}^mC_{ks}A_{ks}T_k$ | 19 | 3913 |
| 1129540 | 2019 | 2034 | 7407 | 7422 | $G_{ks}{}^mC_{ks}A_{ks}{}^mC_{ds}T_{ds}T_{ds}T_{ds}A_{ds}T_{ds}T_{ds}G_{ds}A_{ds}G_{ds}T_{ks}T_{ks}{}^mC_k$ | 48 | 3000 |
| 1129683 | N/A | N/A | 1003 | 1018 | $T_{ks}{}^mC_{ks}A_{ks}A_{ds}{}^mC_{ds}{}^mC_{ds}T_{ds}G_{ds}G_{ds}T_{ds}T_{ds}T_{ds}{}^mC_{ds}A_{ks}{}^mC_{ks}A_k$ | 64 | 3236 |

TABLE 88-continued

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Chemistry notation (5' to 3') | FXII (%UTC) | SEQ ID NO |
|---|---|---|---|---|---|---|---|
| 1129703 | N/A | N/A | 1139 | 1154 | $A_{ks}T_{ks}G_{ks}Ga_{ds}{}^mC_{ds}A_{ds}G_{ds}G_{ds}T_{ds}A_{ds}{}^mC_{ds}{}^mC_{ds}{}^mC_{ds}T_{ks}T_{ks}C_k$ | 32 | 3237 |
| 1129715 | N/A | N/A | 1559 | 1574 | $C_{ks}A_{ks}G_{ks}G_{ds}G_{ds}T_{ds}A_{ds}A_{ds}G_{ds}G_{ds}T_{ds}{}^mC_{ds}{}^mC_{ds}A_{ks}T_{ks}C_k$ | 52 | 2626 |
| 1129783 | N/A | N/A | 2494 | 2509 | $G_{ks}T_{ks}T_{ks}A_{ds}G_{ds}A_{ds}{}^mC_{ds}A_{ds}{}^mC_{ds}T_{ds}T_{ds}G_{ds}A_{ds}T_{ks}T_{ks}{}^mC_k$ | 104 | 3241 |
| 1129796 | N/A | N/A | 2628 | 2643 | $T_{ks}{}^mC_{ks}T_{ks}A_{ds}{}^mC_{ds}T_{ds}T_{ds}A_{ds}G_{ds}T_{ds}G_{ds}{}^mC_{ds}A_{ds}A_{ks}{}^mC_{ks}G_k$ | 57 | 2707 |
| 1129877 | N/A | N/A | 4035 | 4050 | $G_{ks}{}^mC_{ks}T_{ks}A_{ds}C_{ds}T_{ds}{}^mC_{ds}{}^mC_{ds}A_{ds}A_{ds}C_{ds}T_{ds}T_{ks}T_{ks}{}^mC_{ks}{}^mC_k$ | 66 | 2788 |
| 1129916 | N/A | N/A | 4363 | 4378 | $G_{ks}G_{ks}G_{ks}A_{ds}T_{ds}A_{ds}G_{ds}T_{ds}G_{ds}G_{ds}G_{ds}T_{ds}{}^mC_{ds}T_{ds}{}^mC_{ks}A_{ks}G_k$ | 103 | 2713 |
| 1129938 | N/A | N/A | 4635 | 4650 | $A_{ks}{}^mC_{ks}G_{ks}{}^mC_{ds}A_{ds}G_{ds}T_{ds}G_{ds}A_{ds}G_{ds}{}^mC_{ds}{}^mC_{ds}A_{ds}{}^mC_{ks}{}^mC_{ks}{}^mC_k$ | 52 | 2868 |
| 1129943 | N/A | N/A | 4808 | 4823 | $G_{ks}G_{ks}{}^mC_{ks}A_{ds}A_{ds}G_{ds}{}^mC_{ds}{}^mC_{ds}{}^mC_{ds}G_{ds}T_{ds}{}^mC_{ds}{}^mC_{ds}{}^mC_{ks}A_{ks}{}^mC_k$ | 63 | 3249 |
| 1129948 | N/A | N/A | 4840 | 4855 | $A_{ks}T_{ks}{}^mC_{ks}T_{ds}G_{ds}{}^mC_{ds}T_{ds}T_{ds}T_{ds}{}^mC_{ds}{}^mC_{ds}G_{ds}{}^mC_{ds}A_{ks}{}^mC_{ks}T_k$ | 108 | 3630 |
| 1129949 | N/A | N/A | 4844 | 4859 | $T_{ks}{}^mC_{ks}T_{ks}{}^mC_{ds}A_{ds}G_{ds}{}^mC_{ds}T_{ds}G_{ds}{}^mC_{ds}T_{ds}T_{ds}T_{ds}{}^mC_{ks}{}^mC_{ks}G_k$ | 81 | 3706 |
| 1213152 | 141 | 156 | 508 | 523 | $T_{ks}G_{ks}{}^mC_{ks}T_{ds}{}^mC_{ds}U_{ys}T_{ds}{}^mC_{ds}A_{ds}G_{ds}{}^mC_{ds}T_{ds}T_{ds}T_{ks}G_{ks}T_k$ | 72 | 5008 |
| 1213153 | 142 | 157 | 509 | 524 | $G_{ks}T_{ks}G_{ks}{}^mC_{ds}T_{ds}C_{ys}T_{ds}T_{ds}{}^mC_{ds}A_{ds}G_{ds}C_{ds}T_{ds}T_{ks}T_{ks}G_k$ | 29 | 4958 |
| 1213154 | 143 | 158 | 510 | 525 | $T_{ks}G_{ks}T_{ks}G_{ds}{}^mC_{ds}U_{ys}{}^mC_{ds}T_{ds}T_{ds}{}^mC_{ds}A_{ds}G_{ds}{}^mC_{ds}T_{ks}T_{ks}T_k$ | 75 | 5009 |
| 1213155 | 144 | 159 | 511 | 526 | $G_{ks}T_{ks}G_{ks}T_{ds}G_{ds}C_{ys}T_{ds}{}^mC_{ds}T_{ds}T_{ds}{}^mC_{ds}A_{ds}G_{ds}{}^mC_{ks}T_{ks}T_k$ | 70 | 4951 |
| 1213156 | 145 | 160 | 512 | 527 | $T_{ks}G_{ks}T_{ks}G_{ds}T_{ds}G_{ys}{}^mC_{ds}T_{ds}{}^mC_{ds}T_{ds}T_{ds}{}^mC_{ds}A_{ds}G_{ks}{}^mC_{ks}T_k$ | 35 | 3112 |
| 1213157 | 146 | 161 | 513 | 528 | ${}^mC_{ks}T_{ks}G_{ks}T_{ds}G_{ds}U_{ys}G_{ds}{}^mC_{ds}T_{ds}{}^mC_{ds}T_{ds}T_{ds}{}^mC_{ds}A_{ks}G_{ks}{}^mC_k$ | 60 | 5010 |
| 1213158 | 147 | 162 | 514 | 529 | $A_{ks}{}^mC_{ks}T_{ks}G_{ds}T_{ds}G_{ys}T_{ds}G_{ds}{}^mC_{ds}T_{ds}{}^mC_{ds}T_{ds}T_{ds}{}^mC_{ks}A_{ks}G_k$ | 56 | 3267 |
| 1213160 | 149 | 164 | 516 | 531 | ${}^mC_{ks}G_{ks}A_{ks}{}^mC_{ds}T_{ds}G_{ys}T_{ds}G_{ds}T_{ds}G_{ds}{}^mC_{ds}T_{ds}{}^mC_{ds}T_{ks}T_{ks}{}^mC_k$ | 61 | 3419 |
| 1213161 | 150 | 165 | N/A | N/A | $A_{ks}{}^mC_{ks}G_{ks}A_{ds}{}^mC_{ds}U_{ys}G_{ds}T_{ds}G_{ds}T_{ds}G_{ds}{}^mC_{ds}T_{ds}{}^mC_{ks}T_{ks}T_k$ | 36 | 5011 |
| 1213162 | 151 | 166 | N/A | N/A | $A_{ks}A_{ks}{}^mC_{ks}G_{ds}A_{ds}C_{ys}T_{ds}G_{ds}T_{ds}G_{ds}T_{ds}G_{ds}{}^mC_{ds}T_{ks}{}^mC_{ks}T_k$ | 97 | 3571 |
| 1213163 | 152 | 167 | N/A | N/A | $G_{ks}A_{ks}A_{ks}{}^mC_{ds}G_{ds}A_{ys}{}^mC_{ds}T_{ds}G_{ds}T_{ds}G_{ds}T_{ds}G_{ds}{}^mC_{ks}T_{ks}{}^mC_k$ | 50 | 3647 |
| 1213164 | 153 | 168 | N/A | N/A | $A_{ks}G_{ks}A_{ks}A_{ds}{}^mC_{ds}G_{ys}A_{ds}{}^mC_{ds}T_{ds}G_{ds}T_{ds}G_{ds}T_{ds}G_{ks}{}^mC_{ks}T_k$ | 99 | 3723 |
| 1213165 | 154 | 169 | N/A | N/A | $G_{ks}A_{ks}G_{ks}A_{ds}A_{ds}C_{ys}G_{ds}A_{ds}{}^mC_{ds}T_{ds}G_{ds}T_{ds}G_{ds}T_{ks}G_{ks}{}^mC_k$ | 132 | 3799 |

TABLE 88-continued

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Chemistry notation (5' to 3') | FXII (%UTC) | SEQ ID NO |
|---|---|---|---|---|---|---|---|
| 1213166 | 155 | 170 | N/A | N/A | $T_{ks}G_{ks}A_{ks}G_{ds}A_{ds}A_{ys}{}^mC_{ds}G_{ds}A_{ds}{}^mC_{ds}T_{ds}G_{ds}T_{ds}T_{ks}G_{ks}G_{k}$ | 70 | 3875 |
| 1213167 | 156 | 171 | N/A | N/A | $G_{ks}T_{ks}G_{ks}A_{ds}G_{ds}A_{ys}A_{ds}{}^mC_{ds}G_{ds}A_{ds}{}^mC_{ds}T_{ds}G_{ds}T_{ks}G_{ks}T_{k}$ | 45 | 2424 |
| 1213168 | 157 | 172 | N/A | N/A | $A_{ks}G_{ks}T_{ks}G_{ds}A_{ds}G_{ys}A_{ds}A_{ds}{}^mC_{ds}G_{ds}A_{ds}{}^mC_{ds}T_{ds}G_{ks}T_{ks}G_{k}$ | 112 | 2502 |
| 1213169 | 158 | 173 | N/A | N/A | ${}^mC_{ks}A_{ks}G_{ks}T_{ds}G_{ds}A_{ys}G_{ds}A_{ds}A_{ds}{}^mC_{ds}G_{ds}A_{ds}{}^mC_{ds}T_{ks}G_{ks}T_{k}$ | 73 | 2579 |
| 1213170 | 208 | 223 | 3559 | 3574 | $G_{ks}T_{ks}A_{ks}{}^mC_{ds}A_{ds}G_{ys}{}^mC_{ds}T_{ds}G_{ds}{}^mC_{ds}{}^mC_{ds}G_{ds}G_{ds}T_{ks}G_{ks}G_{k}$ | 47 | 4968 |
| 1213171 | 209 | 224 | 3560 | 3575 | $G_{ks}G_{ks}T_{ks}A_{ds}{}^mC_{ds}A_{ys}G_{ds}{}^mC_{ds}T_{ds}G_{ds}{}^mC_{ds}{}^mC_{ds}G_{ds}G_{ds}T_{ks}G_{k}$ | 22 | 4952 |
| 1213173 | 211 | 226 | 3562 | 3577 | $G_{ks}T_{ks}G_{ks}G_{ds}T_{ds}A_{ys}{}^mC_{ds}A_{ds}G_{ds}{}^mC_{ds}T_{ds}G_{ds}{}^mC_{ds}{}^mC_{ks}G_{ks}G_{k}$ | 112 | 4973 |
| 1213174 | 212 | 227 | 3563 | 3578 | $T_{ks}G_{ks}T_{ks}G_{ds}G_{ds}U_{ys}A_{ds}{}^mC_{ds}A_{ds}G_{ds}{}^mC_{ds}T_{ds}G_{ds}{}^mC_{ks}G_{k}$ | 72 | 5012 |
| 1213175 | 213 | 228 | 3564 | 3579 | $T_{ks}T_{ks}G_{ks}T_{ds}G_{ds}G_{ys}T_{ds}A_{ds}{}^mC_{ds}A_{ds}G_{ds}{}^mC_{ds}T_{ds}G_{ks}{}^mC_{ks}{}^mC_{k}$ | 46 | 2811 |
| 1213176 | 214 | 229 | 3565 | 3580 | $T_{ks}T_{ks}T_{ks}G_{ds}T_{ds}G_{ys}G_{ds}T_{ds}A_{ds}{}^mC_{ds}A_{ds}G_{ds}{}^mC_{ds}T_{ks}G_{ks}{}^mC_{k}$ | 62 | 2887 |
| 1213177 | 215 | 230 | 3566 | 3581 | $A_{ks}T_{ks}T_{ks}T_{ds}G_{ds}U_{ys}G_{ds}G_{ds}T_{ds}A_{ds}{}^mC_{ds}A_{ds}G_{ds}{}^mC_{ks}T_{ks}G_{k}$ | 45 | 5013 |
| 1213178 | 216 | 231 | 3567 | 3582 | ${}^mC_{ks}A_{ks}T_{ks}T_{ds}T_{ds}G_{ys}T_{ds}G_{ds}G_{ds}T_{ds}A_{ds}{}^mC_{ds}A_{ds}G_{ds}{}^mC_{ks}T_{k}$ | 33 | 3039 |
| 1213179 | 217 | 232 | 3568 | 3583 | $A_{ks}{}^mC_{ks}A_{ks}T_{ds}T_{ds}U_{ys}G_{ds}T_{ds}G_{ds}G_{ds}T_{ds}A_{ds}{}^mC_{ds}A_{k}G_{ks}{}^mC_{k}$ | 49 | 5014 |
| 1213180 | 218 | 233 | 3569 | 3584 | $T_{ks}A_{ks}{}^mC_{ks}A_{ds}T_{ds}U_{ys}T_{ds}G_{ds}T_{ds}G_{ds}G_{ds}T_{ds}A_{ds}{}^mC_{ks}A_{ks}G_{k}$ | 26 | 5015 |
| 1213181 | 219 | 234 | 3570 | 3585 | $G_{ks}T_{ks}A_{ks}{}^mC_{ds}A_{ds}U_{ys}T_{ds}T_{ds}G_{ds}T_{ds}G_{ds}G_{ds}T_{ds}A_{ks}{}^mC_{ks}A_{k}$ | 50 | 5016 |
| 1213182 | 220 | 235 | 3571 | 3586 | $G_{ks}G_{ks}T_{ks}A_{ds}{}^mC_{ds}A_{ys}T_{ds}T_{ds}T_{ds}G_{ds}T_{ds}G_{ds}G_{ds}T_{ks}A_{ks}{}^mC_{k}$ | 46 | 3269 |
| 1213183 | 221 | 236 | 3572 | 3587 | $G_{ks}G_{ks}G_{ks}T_{ds}A_{ds}C_{ys}A_{ds}T_{ds}T_{ds}T_{ds}G_{ds}T_{ds}G_{ds}G_{ks}T_{ks}A_{k}$ | 117 | 3345 |
| 1213184 | 222 | 237 | 3573 | 3588 | $T_{ks}G_{ks}G_{ks}G_{ds}T_{ds}A_{ys}{}^mC_{ds}A_{ds}T_{ds}T_{ds}T_{ds}G_{ds}T_{ds}G_{ks}G_{ks}T_{k}$ | N/A | 3421 |
| 1213185 | 223 | 238 | 3574 | 3589 | $G_{ks}T_{ks}G_{ks}G_{ds}G_{ds}U_{ys}A_{ds}{}^mC_{ds}A_{ds}T_{ds}T_{ds}T_{ds}G_{ds}T_{ks}G_{ks}G_{k}$ | 63 | 5017 |
| 1213186 | 1776 | 1791 | 7164 | 7179 | $T_{ks}G_{ks}{}^mC_{ds}A_{ds}G_{ds}G_{ys}G_{ds}T_{ds}G_{ds}A_{ds}G_{ds}{}^mC_{ds}{}^mC_{ds}G_{ks}G_{ks}{}^mC_{k}$ | 149 | 3299 |
| 1213187 | 1777 | 1792 | 7165 | 7180 | $T_{ks}T_{ks}G_{ks}{}^mC_{ds}A_{ds}G_{ys}G_{ds}G_{ds}T_{ds}G_{ds}A_{ds}G_{ds}{}^mC_{ds}{}^mC_{ks}G_{ks}G_{k}$ | 98 | 3375 |
| 1213188 | 1778 | 1793 | 7166 | 7181 | ${}^mC_{ks}T_{ks}T_{ks}G_{ds}{}^mC_{ds}A_{ys}G_{ds}G_{ds}G_{ds}T_{ds}G_{ds}A_{ds}G_{ds}{}^mC_{ks}{}^mC_{ks}G_{k}$ | 71 | 4962 |
| 1213189 | 1779 | 1794 | 7167 | 7182 | ${}^mC_{ks}{}^mC_{ks}T_{ks}T_{ds}G_{ds}C_{ys}A_{ds}G_{ds}G_{ds}G_{ds}T_{ds}G_{ds}A_{ds}G_{ks}{}^mC_{ks}{}^mC_{k}$ | 40 | 4974 |

TABLE 88-continued

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Chemistry notation (5' to 3') | FXII (%UTC) | SEQ ID NO |
|---|---|---|---|---|---|---|---|
| 1213190 | 1780 | 1795 | 7168 | 7183 | $G_{ks}{}^mC_{ks}{}^mC_{ks}T_{ds}T_{ds}G_{ys}{}^mC_{ds}A_{ds}G_{ds}G_{ds}G_{ds}T_{ds}G_{ds}A_{ks}G_{ks}{}^mC_k$ | 53 | 3451 |
| 1213192 | 1782 | 1797 | 7170 | 7185 | $A_{ks}T_{ks}G_{ks}{}^mC_{ds}{}^mC_{ds}U_{ys}T_{ds}G_{ds}{}^mC_{ds}A_{ds}G_{ds}G_{ds}G_{ds}T_{ks}G_{ks}A_k$ | 107 | 5018 |
| 1213193 | 1783 | 1798 | 7171 | 7186 | $G_{ks}A_{ks}T_{ks}G_{ds}{}^mC_{ds}C_{ys}T_{ds}G_{ds}{}^mC_{ds}A_{ds}G_{ds}G_{ds}G_{ks}T_{ks}G_k$ | 54 | 4959 |
| 1213194 | 1784 | 1799 | 7172 | 7187 | $T_{ks}G_{ks}A_{ks}T_{ds}G_{ds}C_{ys}{}^mC_{ds}T_{ds}T_{ds}G_{ds}{}^mC_{ds}A_{ds}G_{ds}G_{ks}G_{ks}T_k$ | 28 | 4969 |
| 1213195 | 1785 | 1800 | 7173 | 7188 | $A_{ks}T_{ks}G_{ks}A_{ds}T_{ds}G_{ys}{}^mC_{ds}{}^mC_{ds}T_{ds}T_{ds}G_{ds}{}^mC_{ds}A_{ds}G_{ks}G_{ks}G_k$ | 53 | 3603 |
| 1213196 | 1786 | 1801 | 7174 | 7189 | $G_{ks}A_{ks}T_{ks}G_{ds}A_{ds}U_{ys}G_{ds}{}^mC_{ds}{}^mC_{ds}T_{ds}T_{ds}G_{ds}{}^mC_{ds}A_{ks}G_{ks}G_k$ | 73 | 5019 |
| 1213197 | 1787 | 1802 | 7175 | 7190 | $T_{ks}G_{ks}A_{ks}T_{ds}G_{ds}A_{ys}T_{ds}G_{ds}{}^mC_{ds}{}^mC_{ds}T_{ds}T_{ds}G_{ds}{}^mC_{ks}A_{ks}G_k$ | 43 | 4975 |
| 1213198 | 1788 | 1803 | 7176 | 7191 | ${}^mC_{ks}T_{ks}G_{ks}A_{ds}T_{ds}G_{ys}A_{ds}T_{ds}G_{ds}{}^mC_{ds}{}^mC_{ds}T_{ds}T_{ds}G_{ks}{}^mC_{ks}A_k$ | 65 | 3679 |
| 1213199 | 1789 | 1804 | 7177 | 7192 | $G_{ks}{}^mC_{ks}T_{ks}G_{ds}A_{ds}U_{ys}G_{ds}A_{ds}T_{ds}G_{ds}{}^mC_{ds}{}^mC_{ds}T_{ds}T_{ks}G_{ks}{}^mC_k$ | 80 | 5020 |
| 1213200 | 1790 | 1805 | 7178 | 7193 | $A_{ks}G_{ks}{}^mC_{ks}T_{ds}G_{ds}A_{ys}T_{ds}G_{ds}A_{ds}T_{ds}G_{ds}{}^mC_{ds}{}^mC_{ds}T_{ks}T_{ks}G_k$ | 49 | 3831 |
| 1213201 | 1791 | 1806 | 7179 | 7194 | ${}^mC_{ks}A_{ks}G_{ks}{}^mC_{ds}T_{ds}G_{ys}A_{ds}T_{ds}G_{ds}A_{ds}T_{ds}G_{ds}{}^mC_{ds}{}^mC_{ks}T_{ks}T_k$ | 83 | 4960 |
| 1213202 | 1792 | 1807 | 7180 | 7195 | ${}^mC_{ks}{}^mC_{ks}A_{ks}G_{ds}{}^mC_{ds}U_{ys}G_{ds}A_{ds}T_{ds}G_{ds}A_{ds}T_{ds}G_{ds}{}^mC_{ks}{}^mC_{ks}T_k$ | 44 | 5021 |
| 1213203 | 1793 | 1808 | 7181 | 7196 | ${}^mC_{ks}{}^mC_{ks}{}^mC_{ks}A_{ds}G_{ds}C_{ys}T_{ds}G_{ds}A_{ds}T_{ds}G_{ds}A_{ds}T_{ds}G_{ks}{}^mC_{ks}{}^mC_k$ | 42 | 4953 |
| 1213204 | 1892 | 1907 | 7280 | 7295 | ${}^mC_{ks}{}^mC_{ks}{}^mC_{ks}T_{ds}G_{ds}A_{ys}G_{ds}{}^mC_{ds}A_{ds}A_{ds}T_{ds}{}^mC_{ds}A_{ds}G_{ks}G_{ks}A_k$ | 53 | 3530 |
| 1213205 | 1893 | 1908 | 7281 | 7296 | $T_{ks}{}^mC_{ks}{}^mC_{ks}{}^mC_{ds}T_{ds}G_{ys}A_{ds}G_{ds}{}^mC_{ds}A_{ds}A_{ds}T_{ds}{}^mC_{ds}A_{ks}G_{ks}G_k$ | 104 | 3606 |
| 1213206 | 1894 | 1909 | 7282 | 7297 | $G_{ks}T_{ks}{}^mC_{ks}{}^mC_{ds}{}^mC_{ds}U_{ys}G_{ds}A_{ds}G_{ds}{}^mC_{ds}A_{ds}A_{ds}T_{ds}{}^mC_{ks}A_{ks}G_k$ | 45 | 5022 |
| 1213207 | 1895 | 1910 | 7283 | 7298 | $A_{ks}G_{ks}T_{ks}{}^mC_{ds}{}^mC_{ds}C_{ys}T_{ds}G_{ds}A_{ds}G_{ds}{}^mC_{ds}A_{ds}A_{ds}T_{ks}{}^mC_{ks}A_k$ | 36 | 3758 |
| 1213208 | 1896 | 1911 | 7284 | 7299 | $G_{ks}A_{ks}G_{ks}T_{ds}{}^mC_{ds}C_{ys}{}^mC_{ds}T_{ds}G_{ds}A_{ds}G_{ds}{}^mC_{ds}A_{ds}A_{ks}T_{ks}{}^mC_k$ | 62 | 3834 |
| 1213209 | 1897 | 1912 | 7285 | 7300 | $T_{ks}G_{ks}A_{ks}G_{ds}T_{ds}C_{ys}{}^mC_{ds}{}^mC_{ds}T_{ds}G_{ds}A_{ds}G_{ds}{}^mC_{ds}A_{ks}A_{ks}T_k$ | 46 | 3910 |

TABLE 89

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (%UTC) | SEQ ID NO |
|---|---|---|---|---|---|---|---|
| 1128769 | 153 | 168 | N/A | N/A | $A_{ks}G_{ks}A_{ks}A_{ds}{}^mC_{ds}G_{ds}A_{ds}{}^mC_{ds}T_{ds}G_{ds}T_{ds}$ $G_{ds}T_{ds}G_{ks}{}^mC_{ks}T_k$ | 84 | 3723 |
| 1128796 | 212 | 227 | 3563 | 3578 | $T_{ks}G_{ks}T_{ks}G_{ds}G_{ds}T_{ds}A_{ds}{}^mC_{ds}A_{ds}A_{ds}G_{ds}{}^mC_{ds}$ $T_{ds}G_{ds}{}^mC_{ks}{}^mC_{ks}G_k$ | 103 | 2734 |
| 1128802 | 218 | 233 | 3569 | 3584 | $T_{ks}A_{ks}{}^mC_{ks}A_{ds}T_{ds}T_{ds}T_{ds}G_{ds}T_{ds}G_{ds}G_{ds}$ $T_{ds}A_{ds}{}^mC_{ks}A_{ks}G_k$ | 97 | 2426 |
| 1128870 | 470 | 485 | 4415 | 4430 | $T_{ks}G_{ks}T_{ks}G_{ds}G_{ds}A_{ds}A_{ds}A_{ds}A_{ds}A_{ds}{}^mC_{ds}$ $^mC_{ds}G_{ds}G_{ks}A_{ks}G_k$ | 60 | 3728 |
| 1129221 | 1357 | 1372 | 6017 | 6032 | $^mC_{ks}G_{ks}T_{ks}{}^mC_{ds}T_{ds}G_{ds}G_{ds}{}^mC_{ds}A_{ds}{}^mC_{ds}$ $G_{ds}G_{ds}{}^mC_{ds}T_{ks}{}^mC_{ks}A_k$ | 19 | 3060 |
| 1129407 | 1781 | 1796 | 7169 | 7184 | $T_{ks}G_{ks}{}^mC_{ks}{}^mC_{ds}T_{ds}T_{ds}G_{ds}{}^mC_{ds}A_{ds}G_{ds}$ $G_{ds}G_{ds}T_{ds}G_{ks}A_{ks}G_k$ | 12 | 3527 |
| 1129472 | 1897 | 1912 | 7285 | 7300 | $T_{ks}G_{ks}A_{ks}G_{ds}T_{ds}{}^mC_{ds}{}^mC_{ds}{}^mC_{ds}T_{ds}G_{ds}$ $A_{ds}G_{ds}{}^mC_{ds}A_{ks}A_{ks}T_k$ | 18 | 3910 |
| 1129488 | 1924 | 1939 | 7312 | 7327 | $A_{ks}{}^mC_{ks}T_{ks}G_{ds}{}^mC_{ds}G_{ds}G_{ds}A_{ds}A_{ds}T_{ds}{}^m$ $C_{ds}A_{ds}{}^mC_{ds}{}^mC_{ks}A_{ks}A_k$ | 5 | 3607 |
| 1129491 | 1927 | 1942 | 7315 | 7330 | $^mC_{ks}T_{ks}{}^mC_{ks}A_{ds}C_{ds}T_{ds}G_{ds}{}^mC_{ds}G_{ds}G_{ds}$ $A_{ds}A_{ds}T_{ds}{}^mC_{ks}A_{ks}{}^mC_k$ | 15 | 3835 |
| 1129531 | 2009 | 2024 | 7397 | 7412 | $G_{ks}A_{ks}G_{ks}T_{ds}T_{ds}{}^mC_{ds}{}^mC_{ds}T_{ds}G_{ds}{}^mC_{ds}$ $G_{ds}{}^mC_{ds}A_{ds}T_{ks}T_{ks}{}^mC_k$ | 12 | 3837 |
| 1129532 | 2010 | 2025 | 7398 | 7413 | $T_{ks}G_{ks}A_{ks}G_{ds}T_{ds}T_{ds}{}^mC_{ds}{}^mC_{ds}T_{ds}G_{ds}{}^m$ $C_{ds}G_{ds}{}^mC_{ds}{}^mC_{ks}A_{ks}T_k$ | 11 | 3913 |
| 1129533 | 2011 | 2026 | 7399 | 7414 | $T_{ks}T_{ks}G_{ks}A_{ds}G_{ds}T_{ds}T_{ds}{}^mC_{ds}{}^mC_{ds}T_{ds}G_{ds}$ $^mC_{ds}G_{ds}{}^mC_{ks}{}^mC_{ks}A_k$ | 8 | 2463 |
| 1129540 | 2019 | 2034 | 7407 | 7422 | $G_{ks}{}^mC_{ks}A_{ks}{}^mC_{ds}T_{ds}T_{ds}T_{ds}A_{ds}T_{ds}T_{ds}G_{ds}$ $A_{ds}G_{ds}T_{ks}T_{ks}{}^mC_k$ | 4 | 3000 |
| 1129542 | 2021 | 2036 | 7409 | 7424 | $A_{ks}A_{ks}G_{ks}{}^mC_{ds}A_{ds}{}^mC_{ds}T_{ds}T_{ds}T_{ds}A_{ds}T_{ds}$ $T_{ds}G_{ds}A_{ks}G_{ks}T_k$ | 17 | 3147 |
| 1129565 | N/A | N/A | 144 | 159 | $A_{ks}T_{ks}A_{ks}G_{ds}{}^mC_{ds}G_{ds}A_{ds}{}^mC_{ds}{}^mC_{ds}{}^mC_{ds}$ $^mC_{ds}{}^mC_{ds}{}^mC_{ds}A_{ks}G_{ks}A_k$ | 82 | 3383 |
| 1129744 | N/A | N/A | 2082 | 2097 | $T_{ks}G_{ks}G_{ks}A_{ds}{}^mC_{ds}{}^mC_{ds}T_{ds}T_{ds}T_{ds}A_{ds}A_{ds}$ $G_{ds}A_{ds}T_{ks}G_{ks}{}^mC_k$ | 75 | 3316 |
| 1129864 | N/A | N/A | 3897 | 3912 | $T_{ks}G_{ks}G_{ks}T_{ds}G_{ds}A_{ds}A_{ds}T_{ds}A_{ds}{}^mC_{ds}A_{ds}$ $G_{ds}G_{ds}A_{ks}G_{ks}A_k$ | 74 | 3322 |
| 1129946 | N/A | N/A | 4812 | 4827 | $T_{ks}{}^mC_{ks}{}^mC_{ks}T_{ds}G_{ds}G_{ds}{}^mC_{ds}A_{ds}A_{ds}G_{ds}{}^m$ $C_{ds}{}^mC_{ds}{}^mC_{ds}G_{ks}T_{ks}{}^mC_k$ | 119 | 3478 |
| 1129948 | N/A | N/A | 4840 | 4855 | $A_{ks}T_{ks}{}^mC_{ks}T_{ds}G_{ds}{}^mC_{ds}T_{ds}T_{ds}T_{ds}{}^mC_{ds}{}^m$ $C_{ds}G_{ds}{}^mC_{ds}A_{ks}{}^mC_{ks}T_k$ | 77 | 3630 |
| 1129949 | N/A | N/A | 4844 | 4859 | $T_{ks}{}^mC_{ks}T_{ks}{}^mC_{ds}A_{ds}T_{ds}{}^mC_{ds}T_{ds}G_{ds}{}^mC_{ds}$ $T_{ds}T_{ds}T_{ds}{}^mC_{ks}{}^mC_{ks}G_k$ | 84 | 3706 |
| 1213210 | 1898 | 1913 | 7286 | 7301 | $A_{ks}T_{ks}G_{ks}A_{ds}G_{ds}U_{ys}{}^mC_{ds}{}^mC_{ds}{}^mC_{ds}T_{ds}$ $G_{ds}A_{ds}G_{ds}{}^mC_{ks}A_{ks}A_k$ | 40 | 5023 |
| 1213211 | 1899 | 1914 | 7287 | 7302 | $G_{ks}A_{ks}T_{ks}G_{ds}A_{ds}G_{ys}T_{ds}{}^mC_{ds}{}^mC_{ds}{}^mC_{ds}$ $T_{ds}G_{ds}A_{ds}G_{ks}{}^mC_{ks}A_k$ | 27 | 2537 |
| 1213212 | 1900 | 1915 | 7288 | 7303 | $A_{ks}G_{ks}A_{ks}T_{ds}G_{ds}A_{ys}G_{ds}T_{ds}{}^mC_{ds}{}^mC_{ds}{}^m$ $C_{ds}T_{ds}G_{ds}A_{ks}G_{ks}{}^mC_k$ | 24 | 2614 |
| 1213213 | 1901 | 1916 | 7289 | 7304 | $A_{ks}A_{ks}G_{ks}A_{ds}T_{ds}G_{ys}A_{ds}G_{ds}T_{ds}{}^mC_{ds}{}^m$ $C_{ds}{}^mC_{ds}T_{ds}G_{ks}A_{ks}G_k$ | 19 | 2691 |

TABLE 89-continued

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (%UTC) | SEQ ID NO |
|---|---|---|---|---|---|---|---|
| 1213214 | 1902 | 1917 | 7290 | 7305 | $A_{ks}A_{ks}A_{ks}G_{ds}A_{ds}U_{ys}G_{ds}A_{ds}G_{ds}T_{ds}{}^mC_{ds}{}^mC_{ds}{}^mC_{ds}T_{ks}G_{ks}A_k$ | 31 | 5024 |
| 1213215 | 1903 | 1918 | 7291 | 7306 | $G_{ks}A_{ks}A_{ks}A_{ds}G_{ds}A_{ys}T_{ds}G_{ds}A_{ds}G_{ds}T_{ds}{}^mC_{ds}{}^mC_{ds}{}^mC_{ks}T_{ks}G_k$ | 23 | 2845 |
| 1213216 | 1904 | 1919 | 7292 | 7307 | $G_{ks}G_{ks}A_{ks}A_{ds}A_{ds}G_{ys}A_{ds}T_{ds}G_{ds}A_{ds}G_{ds}T_{ds}{}^mC_{ds}{}^mC_{ks}{}^mC_{ks}T_k$ | 39 | 2921 |
| 1213217 | 1905 | 1920 | 7293 | 7308 | $G_{ks}G_{ks}G_{ks}A_{ds}A_{ds}A_{ys}G_{ds}A_{ds}T_{ds}G_{ds}A_{ds}G_{ds}T_{ds}{}^mC_{ks}{}^mC_{ks}{}^mC_k$ | 55 | 2997 |
| 1213218 | 1906 | 1921 | 7294 | 7309 | $A_{ks}G_{ks}G_{ks}G_{ds}A_{ds}A_{ys}A_{ds}G_{ds}A_{ds}T_{ds}G_{ds}A_{ds}G_{ds}T_{ks}{}^mC_{ks}{}^mC_k$ | 18 | 3073 |
| 1213219 | 1914 | 1929 | 7302 | 7317 | ${}^mC_{ks}A_{ks}{}^mC_{ks}{}^mC_{ds}A_{ds}A_{ys}G_{ds}G_{ds}A_{ds}G_{ds}G_{ds}G_{ds}A_{ds}A_{ks}A_{ks}G_k$ | 31 | 4954 |
| 1213220 | 1915 | 1930 | 7303 | 7318 | $T_{ks}{}^mC_{ks}A_{ks}{}^mC_{ds}{}^mC_{ds}A_{ys}G_{ds}G_{ds}A_{ds}G_{ds}G_{ds}G_{ds}A_{ds}A_{ks}A_{ks}A_k$ | 9 | 4948 |
| 1213221 | 1916 | 1931 | 7304 | 7319 | $A_{ks}T_{ks}{}^mC_{ks}A_{ds}{}^mC_{ds}C_{ys}A_{ds}G_{ds}G_{ds}A_{ds}G_{ds}G_{ds}G_{ks}A_{ks}A_k$ | 31 | 4966 |
| 1213222 | 1917 | 1932 | 7305 | 7320 | $A_{ks}A_{ks}T_{ks}{}^mC_{ds}A_{ds}C_{ys}{}^mC_{ds}A_{ds}G_{ds}G_{ds}A_{ds}G_{ds}G_{ks}G_{ks}A_k$ | 44 | 4956 |
| 1213223 | 1918 | 1933 | 7306 | 7321 | $G_{ks}A_{ks}A_{ks}T_{ds}{}^mC_{ds}A_{ys}{}^mC_{ds}Ca_{ds}{}^mC_{ds}A_{ds}A_{ds}G_{ds}G_{ds}A_{ds}G_{ks}G_{ks}G_k$ | 28 | 4965 |
| 1213224 | 1919 | 1934 | 7307 | 7322 | $G_{ks}G_{ks}A_{ks}A_{ds}T_{ds}C_{ys}A_{ds}{}^mC_{ds}{}^mC_{ds}A_{ds}A_{ds}G_{ds}G_{ds}A_{ks}G_{ks}G_k$ | 21 | 3226 |
| 1213225 | 1920 | 1935 | 7308 | 7323 | ${}^mC_{ks}G_{ks}G_{ks}A_{ds}A_{ds}U_{ys}{}^mC_{ds}A_{ds}{}^mC_{ds}{}^mC_{ds}A_{ds}A_{ds}G_{ds}G_{ks}A_{ks}G_k$ | 33 | 5025 |
| 1213226 | 1921 | 1936 | 7309 | 7324 | $G_{ks}{}^mC_{ks}G_{ks}G_{ds}A_{ds}A_{ys}T_{ds}{}^mC_{ds}A_{ds}{}^mC_{ds}{}^mC_{ds}A_{ds}A_{ds}G_{ks}G_{ks}A_k$ | 21 | 3379 |
| 1213227 | 1922 | 1937 | 7310 | 7325 | $T_{ks}G_{ks}{}^mC_{ks}G_{ds}G_{ds}A_{ys}A_{ds}T_{ds}{}^mC_{ds}A_{ds}{}^mC_{ds}{}^mC_{ds}A_{ds}A_{ks}G_{ks}G_k$ | 8 | 3455 |
| 1213228 | 1923 | 1938 | 7311 | 7326 | ${}^mC_{ks}T_{ks}G_{ks}{}^mC_{ds}G_{ds}G_{ys}A_{ds}A_{ds}T_{ds}{}^mC_{ds}A_{ds}{}^mC_{ds}{}^mC_{ds}A_{ks}A_{ks}G_k$ | 17 | 3531 |
| 1213229 | 1924 | 1939 | 7312 | 7327 | $A_{ks}{}^mC_{ks}T_{ks}G_{ds}{}^mC_{ds}G_{ys}G_{ds}A_{ds}A_{ds}T_{ds}{}^mC_{ds}A_{ds}{}^mC_{ds}{}^mC_{ks}A_{ks}A_k$ | 12 | 3607 |
| 1213230 | 1925 | 1940 | 7313 | 7328 | ${}^mC_{ks}A_{ks}{}^mC_{ks}T_{ds}G_{ds}C_{ys}G_{ds}G_{ds}A_{ds}A_{ds}T_{ds}{}^mC_{ds}A_{ds}{}^mC_{ks}{}^mC_{ks}A_k$ | 22 | 3683 |
| 1213231 | 1926 | 1941 | 7314 | 7329 | $T_{ks}{}^mC_{ks}A_{ks}{}^mC_{ds}T_{ds}G_{ys}{}^mC_{ds}G_{ds}G_{ds}A_{ds}A_{ds}T_{ds}{}^mC_{ds}A_{ks}{}^mC_{ks}{}^mC_k$ | 23 | 3759 |
| 1213232 | 1927 | 1942 | 7315 | 7330 | ${}^mC_{ks}T_{ks}{}^mC_{ks}A_{ds}{}^mC_{ds}U_{ys}G_{ds}{}^mC_{ds}G_{ds}G_{ds}A_{ds}A_{ds}T_{ds}{}^mC_{ks}A_{ks}{}^mC_k$ | 11 | 5026 |
| 1213233 | 1928 | 1943 | 7316 | 7331 | $T_{ks}{}^mC_{ks}T_{ks}{}^mC_{ds}A_{ds}C_{ys}T_{ds}G_{ds}{}^mC_{ds}G_{ds}G_{ds}A_{ds}A_{ds}T_{ks}{}^mC_{ks}A_k$ | 16 | 3911 |
| 1213234 | 1929 | 1944 | 7317 | 7332 | ${}^mC_{ks}T_{ks}{}^mC_{ks}T_{ds}{}^mC_{ds}A_{ys}{}^mC_{ds}T_{ds}G_{ds}{}^mC_{ds}G_{ds}G_{ds}A_{ds}A_{ks}T_{ks}{}^mC_k$ | 11 | 4971 |
| 1213235 | 1930 | 1945 | 7318 | 7333 | $T_{ks}{}^mC_{ks}T_{ks}{}^mC_{ds}T_{ds}C_{ys}A_{ds}{}^mC_{ds}T_{ds}G_{ds}{}^mC_{ds}G_{ds}G_{ds}A_{ks}A_{ks}T_k$ | 11 | 4955 |
| 1213236 | 1931 | 1946 | 7319 | 7334 | ${}^mC_{ks}T_{ks}{}^mC_{ks}T_{ds}{}^mC_{ds}U_{ys}{}^mC_{ds}A_{ds}{}^mC_{ds}T_{ds}G_{ds}{}^mC_{ds}G_{ds}G_{ks}A_{ks}A_k$ | 34 | 5027 |

TABLE 89-continued

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (%UTC) | SEQ ID NO |
|---|---|---|---|---|---|---|---|
| 1213237 | 1932 | 1947 | 7320 | 7335 | $A_{ks}{}^mC_{ks}T_{ks}{}^mC_{ds}T_{ds}C_{ys}T_{ds}{}^mC_{ds}A_{ds}{}^mC_{ds}T_{ds}G_{ds}{}^mC_{ds}G_{ks}G_{ks}A_k$ | 20 | 4976 |
| 1213238 | 1933 | 1948 | 7321 | 7336 | ${}^mC_{ks}A_{ks}{}^mC_{ks}T_{ds}{}^mC_{ds}U_{ys}{}^mC_{ds}T_{ds}{}^mC_{ds}A_{ds}{}^mC_{ds}T_{ds}G_{ds}{}^mC_{ks}G_{ks}G_k$ | 26 | 5028 |
| 1213239 | 1934 | 1949 | 7322 | 7337 | ${}^mC_{ks}{}^mC_{ks}A_{ks}{}^mC_{ds}T_{ds}C_{ys}T_{ds}{}^mC_{ds}T_{ds}{}^mC_{ds}A_{ds}{}^mC_{ds}T_{ds}G_{ds}{}^mC_{ks}G_k$ | 18 | 4949 |
| 1213240 | 1935 | 1950 | 7323 | 7338 | $G_{ks}{}^mC_{ks}{}^mC_{ks}A_{ds}{}^mC_{ds}U_{ys}{}^mC_{ds}T_{ds}{}^mC_{ds}T_{ds}{}^mC_{ds}A_{ds}{}^mC_{ds}T_{ks}G_{ks}{}^mC_k$ | 32 | 5029 |
| 1213241 | 1936 | 1951 | 7324 | 7339 | $A_{ks}G_{ks}{}^mC_{ks}{}^mC_{ds}A_{ds}C_{ys}T_{ds}{}^mC_{ds}T_{ds}{}^mC_{ds}T_{ds}{}^mC_{ds}A_{ds}{}^mC_{ks}T_{ks}G_k$ | 28 | 4961 |
| 1213242 | 1937 | 1952 | 7325 | 7340 | ${}^mC_{ks}A_{ks}G_{ks}{}^mC_{ds}{}^mC_{ds}A_{ys}{}^mC_{ds}T_{ds}{}^mC_{ds}T_{ds}{}^mC_{ds}T_{ds}{}^mC_{ds}A_{ks}{}^mC_{ks}T_k$ | 55 | 4972 |
| 1213243 | 2000 | 2015 | 7388 | 7403 | ${}^mC_{ks}G_{ks}{}^mC_{ks}{}^mC_{ds}A_{ds}U_{ys}{}^mC_{ds}{}^mC_{ds}T_{ds}G_{ds}G_{ds}{}^mC_{ds}G_{ds}{}^mC_{ks}G_{ks}G_k$ | 92 | 5030 |
| 1213244 | 2001 | 2016 | 7389 | 7404 | $G_{ks}{}^mC_{ks}G_{ks}{}^mC_{ds}{}^mC_{ds}A_{ys}T_{ds}{}^mC_{ds}{}^mC_{ds}T_{ds}G_{ds}G_{ds}{}^mC_{ds}G_{ks}{}^mC_{ks}G_k$ | 92 | 4964 |
| 1213245 | 2002 | 2017 | 7390 | 7405 | $T_{ks}G_{ks}{}^mC_{ks}G_{ds}{}^mC_{ds}C_{ys}A_{ds}T_{ds}{}^mC_{ds}{}^mC_{ds}T_{ds}G_{ds}G_{ds}{}^mC_{ks}G_{ks}{}^mC_k$ | 71 | 3305 |
| 1213246 | 2003 | 2018 | 7391 | 7406 | ${}^mC_{ks}T_{ks}G_{ks}{}^mC_{ds}G_{ds}C_{ys}{}^mC_{ds}A_{ds}T_{ds}{}^mC_{ds}{}^mC_{ds}T_{ds}G_{ds}G_{ks}{}^mC_{ks}G_k$ | 54 | 3381 |
| 1213247 | 2004 | 2019 | 7392 | 7407 | ${}^mC_{ks}{}^mC_{ks}T_{ks}G_{ds}{}^mC_{ds}G_{ys}{}^mC_{ds}{}^mC_{ds}A_{ds}T_{ds}{}^mC_{ds}{}^mC_{ds}T_{ds}G_{ks}G_{ks}{}^mC_k$ | 54 | 3457 |
| 1213248 | 2005 | 2020 | 7393 | 7408 | $T_{ks}{}^mC_{ks}{}^mC_{ks}T_{ds}G_{ds}C_{ys}G_{ds}{}^mC_{ds}{}^mC_{ds}A_{ds}T_{ds}{}^mC_{ds}{}^mC_{ds}T_{ks}G_{ks}G_k$ | 21 | 3533 |
| 1213249 | 2006 | 2021 | 7394 | 7409 | $T_{ks}T_{ks}{}^mC_{ks}{}^mC_{ds}T_{ds}G_{ys}{}^mC_{ds}G_{ds}{}^mC_{ds}{}^mC_{ds}A_{ds}T_{ds}{}^mC_{ds}{}^mC_{ks}T_{ks}G_k$ | 64 | 3609 |
| 1213250 | 2007 | 2022 | 7395 | 7410 | $G_{ks}T_{ks}T_{ks}{}^mC_{ds}{}^mC_{ds}U_{ys}G_{ds}{}^mC_{ds}G_{ds}{}^mC_{ds}{}^mC_{ds}A_{ds}T_{ds}{}^mC_{ks}{}^mC_{ks}T_k$ | 30 | 5031 |
| 1213251 | 2008 | 2023 | 7396 | 7411 | $A_{ks}G_{ks}T_{ks}T_{ds}{}^mC_{ds}C_{ys}T_{ds}G_{ds}{}^mC_{ds}G_{ds}{}^mC_{ds}{}^mC_{ds}A_{ds}T_{ks}{}^mC_{ks}{}^mC_k$ | 21 | 3761 |
| 1213252 | 2009 | 2024 | 7397 | 7412 | $G_{ks}A_{ks}G_{ks}T_{ds}T_{ds}C_{ys}{}^mC_{ds}T_{ds}G_{ds}{}^mC_{ds}G_{ds}{}^mC_{ds}{}^mC_{ds}A_{ks}T_{ks}{}^mC_k$ | 24 | 3837 |
| 1213253 | 2010 | 2025 | 7398 | 7413 | $T_{ks}G_{ks}A_{ks}G_{ds}T_{ds}U_{ys}{}^mC_{ds}{}^mC_{ds}T_{ds}G_{ds}{}^mC_{ds}G_{ds}{}^mC_{ds}{}^mC_{ks}A_{ks}T_k$ | 17 | 5032 |
| 1213254 | 2011 | 2026 | 7399 | 7414 | $T_{ks}T_{ks}G_{ks}A_{ds}G_{ds}U_{ys}T_{ds}{}^mC_{ds}{}^mC_{ds}T_{ds}G_{ds}{}^mC_{ds}G_{ds}{}^mC_{ks}{}^mC_{ks}A_k$ | 30 | 5033 |
| 1213255 | 2012 | 2027 | 7400 | 7415 | $A_{ks}T_{ks}T_{ks}G_{ds}A_{ds}G_{ys}T_{ds}T_{ds}{}^mC_{ds}{}^mC_{ds}T_{ds}G_{ds}{}^mC_{ds}G_{ks}{}^mC_{ks}{}^mC_k$ | 20 | 2540 |
| 1213256 | 2013 | 2028 | 7401 | 7416 | $T_{ks}A_{ks}T_{ks}T_{ds}G_{ds}A_{ys}G_{ds}T_{ds}T_{ds}{}^mC_{ds}{}^mC_{ds}T_{ds}G_{ds}{}^mC_{ks}G_{ks}{}^mC_k$ | 26 | 2617 |
| 1213257 | 2014 | 2029 | 7402 | 7417 | $T_{ks}T_{ks}A_{ks}T_{ds}T_{ds}G_{ys}A_{ds}G_{ds}T_{ds}T_{ds}{}^mC_{ds}{}^mC_{ds}T_{ds}G_{ks}{}^mC_{ks}G_k$ | 21 | 2694 |
| 1213258 | 2016 | 2031 | 7404 | 7419 | ${}^mC_{ks}T_{ks}T_{ks}T_{ds}A_{ds}U_{ys}T_{ds}G_{ds}A_{ds}G_{ds}T_{ds}T_{ds}{}^mC_{ds}{}^mC_{ks}T_{ks}G_k$ | 19 | 5034 |
| 1213259 | 2017 | 2032 | 7405 | 7420 | $A_{ks}{}^mC_{ks}T_{ks}T_{ds}T_{ds}A_{ys}T_{ds}T_{ds}G_{ds}A_{ds}G_{ds}T_{ds}T_{ds}{}^mC_{ks}{}^mC_{ks}T_k$ | 2 | 2848 |

TABLE 89-continued

Reduction of FXII RNA (Huh7, electroporation, 2000 nM modified oligonucleotide)

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | FXII (%UTC) | SEQ ID NO |
|---|---|---|---|---|---|---|---|
| 1213260 | 2018 | 2033 | 7406 | 7421 | $^mC_{ks}A_{ks}{}^mC_{ks}T_{ds}T_{ds}U_{ys}A_{ds}T_{ds}T_{ds}G_{ds}A_{ds}G_{ds}T_{ds}T_{ks}{}^mC_{ks}{}^mC_k$ | 2 | 5035 |
| 1213261 | 2019 | 2034 | 7407 | 7422 | $G_{ks}{}^mC_{ks}A_{ks}{}^mC_{ds}T_{ds}U_{ys}T_{ds}A_{ds}T_{ds}T_{ds}G_{ds}A_{ds}G_{ds}T_{ks}T_{ks}{}^mC_k$ | 12 | 5036 |
| 1213262 | 2020 | 2035 | 7408 | 7423 | $A_{ks}G_{ks}{}^mC_{ks}A_{ds}{}^mC_{ds}U_{ys}T_{ds}T_{ds}A_{ds}T_{ds}T_{ds}G_{ds}A_{ds}G_{ks}T_{ks}T_k$ | 4 | 5037 |
| 1213263 | 2021 | 2036 | 7409 | 7424 | $A_{ks}A_{ks}G_{ks}{}^mC_{ds}A_{ds}C_{ys}T_{ds}T_{ds}T_{ds}A_{ds}T_{ds}T_{ds}G_{ds}A_{ks}G_{ks}T_k$ | 19 | 3147 |
| 1213264 | 2022 | 2037 | 7410 | 7425 | $A_{ks}A_{ks}A_{ks}G_{ds}{}^mC_{ds}A_{ys}{}^mC_{ds}T_{ds}T_{ds}T_{ds}A_{ds}T_{ds}T_{ds}G_{ks}A_{ks}G_k$ | 11 | 3229 |
| 1213265 | 2023 | 2038 | 7411 | 7426 | $^mC_{ks}A_{ks}A_{ks}A_{ds}G_{ds}C_{ys}A_{ds}{}^mC_{ds}T_{ds}T_{ds}T_{ds}A_{ds}T_{ks}T_{ks}G_{ks}A_k$ | 19 | 3306 |
| 1213266 | 2024 | 2039 | 7412 | 7427 | $T_{ks}{}^mC_{ks}A_{ks}A_{ds}A_{ds}G_{ys}{}^mC_{ds}A_{ds}{}^mC_{ds}T_{ds}T_{ds}T_{ds}A_{ds}T_{ks}T_{ks}G_k$ | 54 | 3382 |
| 1213267 | 2031 | 2046 | 7419 | 7434 | $A_{ks}G_{ks}{}^mC_{ks}A_{ds}T_{ds}U_{ys}T_{ds}T_{ds}{}^mC_{ds}A_{ds}A_{ds}A_{ds}G_{ds}{}^mC_{ks}A_{ks}{}^mC_k$ | 23 | 5038 |
| 1213268 | 2033 | 2048 | 7421 | 7436 | $T_{ks}{}^mC_{ks}A_{ks}G_{ds}{}^mC_{ds}A_{ys}T_{ds}T_{ds}T_{ds}T_{ds}{}^mC_{ds}A_{ds}A_{ds}A_{ks}G_{ks}C_k$ | 20 | 3534 |

Example 5: Dose-Dependent Reduction of Human FXII RNA by Modified Oligonucleotides In Vitro Certain modified oligonucleotides described in the studies above exhibiting significant in vitro inhibition of FXII RNA were selected and tested at various doses in HepG2 cells.

The modified oligonucleotides were tested in a series of experiments using the same culture conditions. The results for each experiment are presented in separate tables shown below. Cultured HepG2 cells at a density of 10,000 cells per well were transfected using lipofectin with modified oligonucleotides diluted to different concentrations as specified in the tables below. After a treatment period of approximately 24 hours, FXII RNA levels were measured as previously described using the Human FXII primer-probe set RTS2976_MGB (forward sequence CCGG-GAGCACACCGTTT, designated herein as SEQ ID NO: 11; reverse sequence GGAATCACCAAGGAGGGAAAG, designated herein as SEQ ID NO: 12; probe sequence CTGAT-TGCTCAGGGACT, designated herein as SEQ ID NO: 13). FXII RNA levels were normalized to total RNA, as measured by RIBOGREEN®. Reduction of FXII RNA is presented in the tables below as percent FXII RNA relative to the amount in untreated control cells (% UTC).

The half maximal inhibitory concentration ($IC_{50}$) of each modified oligonucleotide was calculated using a linear regression on a log/linear plot of the data in excel and is also presented in the tables below.

TABLE 90

Dose-dependent reduction of human FXII RNA by modified oligonucleotides

| Compound Number | FXII (% UTC) | | | | | 150 nM | IC50 (µM) |
|---|---|---|---|---|---|---|---|
| | 5 nM | 9 nM | 19 nM | 38 nM | 75 nM | | |
| 413627 | 74 | 57 | 45 | 30 | 22 | 18 | 0.02 |
| 413631 | 77 | 66 | 46 | 36 | 27 | 11 | 0.02 |
| 413632 | 80 | 64 | 53 | 42 | 27 | 21 | 0.02 |
| 413636 | 87 | 71 | 58 | 44 | 28 | 21 | 0.03 |
| 413637 | 85 | 66 | 56 | 36 | 24 | 15 | 0.02 |
| 413642 | 72 | 57 | 42 | 32 | 17 | 11 | 0.01 |
| 413643 | 75 | 50 | 37 | 25 | 18 | 13 | 0.01 |
| 413644 | 81 | 77 | 54 | 39 | 29 | 18 | 0.03 |
| 413645 | 80 | 69 | 51 | 35 | 28 | 21 | 0.02 |
| 413652 | 77 | 62 | 46 | 32 | 21 | 12 | 0.02 |

Example 6: Dose-Dependent Reduction of Human FXII RNA by Modified Oligonucleotides In Vitro Certain modified oligonucleotides described in the studies above exhibiting significant in vitro inhibition of FXII RNA were selected and tested at various doses in Huh7 cells.

The modified oligonucleotides were tested in a series of experiments using the same culture conditions. The results for each experiment are presented in separate tables shown below. Cultured Huh7 cells at a density of 5,000 cells per well were transfected using oligofectamine with modified oligonucleotides diluted to different concentrations as specified in the tables below. After a treatment period of approximately 24 hours, FXII RNA levels were measured as previously described using the Human FXII primer-probe set RTS2992. FXII RNA levels were normalized to total RNA, as measured by RIBOGREEN®. Reduction of FXII RNA is presented in the tables below as percent FXII RNA relative to the amount in untreated control cells (% UTC).

The half maximal inhibitory concentration (IC$_{50}$) of each modified oligonucleotide was calculated using a linear regression on a log/linear plot of the data in excel and is also presented in the tables below. The symbol "†" indicates that the modified oligonucleotide is complementary to the target transcript within the amplicon region of the primer probe set. In such instances, additional assays using alternative primer probes must be performed to accurately assess the potency and efficacy of such modified oligonucleotides.

TABLE 91

Dose-dependent reduction of human FXII RNA by modified oligonucleotides

| Compound Number | FXII (% UTC) | | | | | IC$_{50}$ μM |
|---|---|---|---|---|---|---|
| | 14 nM | 28 nM | 55 nM | 110 nM | 220 nM | |
| 462145 | 87 | 68 | 48 | 37 | 20 | 0.06 |
| 462147 | 80 | 66 | 43 | 34 | 28 | 0.056 |
| 462176 | 95 | 79 | 67 | 56 | 31 | 0.113 |
| 462183 | 76 | 64 | 52 | 39 | 24 | 0.058 |
| 462189 | 56 | 60 | 37 | 25 | 22 | 0.028 |
| 462190 | 72 | 67 | 52 | 34 | 26 | 0.056 |
| 462192 | 53 | 44 | 32 | 15 | 22 | 0.015 |
| 462193 | 86 | 75 | 48 | 43 | 27 | 0.072 |
| 462195 | 50 | 42 | 35 | 19 | 23 | 0.013 |
| 462196 | 53 | 31 | 36 | 17 | 19 | 0.012 |
| 462197 | 46 | 40 | 31 | 17 | 15 | <14 nM |
| 462198 | 42 | 34 | 32 | 27 | 19 | <14 nM |

TABLE 92

Dose-dependent reduction of human FXII RNA by modified oligonucleotides

| Compound Number | FXII (% UTC) | | | | | IC$_{50}$ μM |
|---|---|---|---|---|---|---|
| | 14 nM | 28 nM | 55 nM | 110 nM | 220 nM | |
| 462072 | 80 | 55 | 40 | 26 | 12 | 0.041 |
| 462073 | 81 | 47 | 30 | 22 | 23 | 0.035 |
| 462098 | 89 | 89 | 57 | 38 | 19 | 0.075 |
| 462107 | 90 | 88 | 54 | 58 | 32 | 0.109 |
| 462131 | 69 | 61 | 68 | 42 | 34 | 0.08 |
| 462188 | 95 | 84 | 52 | 46 | 41 | 0.106 |
| 462194 | 73 | 63 | 50 | 40 | 49 | 0.087 |
| 462199 | 50 | 46 | 44 | 28 | 31 | 0.016 |
| 462064† | 73 | 62 | 32 | 16 | 13 | N/A |
| 462065† | 66 | 48 | 41 | 13 | 4 | N/A |
| 462068† | 56 | 52 | 29 | 15 | 8 | N/A |
| 462069† | 81 | 57 | 53 | 21 | 10 | N/A |

Example 7: Dose-Dependent Reduction of Human FXII RNA by Modified Oligonucleotides In Vitro Certain modified oligonucleotides described in the studies above exhibiting significant in vitro inhibition of FXII RNA were selected and tested at various doses in Huh7 cells.

The modified oligonucleotides were tested in a series of experiments using the same culture conditions. The results for each experiment are presented in separate tables shown below. Cultured Huh7 cells at a density of 20,000 cells per well were transfected using electroporation with modified oligonucleotides diluted to different concentrations as specified in the tables below. After a treatment period of approximately 24 hours, FXII RNA levels were measured as previously described using the Human FXII primer-probe set RTS40528. FXII RNA levels were normalized to total RNA, as measured by RIBOGREEN®. Reduction of FXII RNA is presented in the tables below as percent FXII RNA relative to the amount in untreated control cells (% UTC).

The half maximal inhibitory concentration (IC$_{50}$) of each modified oligonucleotide was calculated using a linear regression on a log/linear plot of the data in excel and is also presented in the tables below.

TABLE 93

Dose-dependent reduction of human FXII RNA by modified oligonucleotides

| Compound Number | FXII (% UTC) | | | | IC$_{50}$ μM |
|---|---|---|---|---|---|
| | 47 nM | 188 nM | 750 nM | 3000 nM | |
| 1128754 | 94 | 82 | 66 | 37 | 1.6 |
| 1128802 | 81 | 54 | 38 | 16 | 0.3 |
| 1128835 | 92 | 83 | 57 | 37 | 1.3 |
| 1128873 | 91 | 75 | 63 | 42 | 1.8 |
| 1128874 | 93 | 67 | 41 | 17 | 0.5 |
| 1128875 | 93 | 76 | 60 | 36 | 1.3 |
| 1129015 | 93 | 71 | 44 | 30 | 0.7 |
| 1129094 | 81 | 66 | 42 | 24 | 0.5 |
| 1129114 | 92 | 64 | 50 | 23 | 0.6 |
| 1129294 | 86 | 55 | 55 | 30 | 0.6 |
| 1129473 | 84 | 63 | 37 | 22 | 0.4 |
| 1129475 | 76 | 50 | 28 | 15 | 0.2 |
| 1129476 | 70 | 44 | 40 | 22 | 0.2 |
| 1129493 | 81 | 48 | 23 | 11 | 0.2 |
| 1129494 | 87 | 85 | 45 | 26 | 0.7 |
| 1129533 | 65 | 54 | 21 | 21 | 0.2 |
| 1129534 | 77 | 46 | 36 | 17 | 0.2 |
| 1129535 | 80 | 64 | 32 | 25 | 0.4 |
| 1129536 | 85 | 47 | 30 | 25 | 0.3 |

TABLE 94

Dose-dependent reduction of human FXII RNA by modified oligonucleotides

| Compound Number | FXII (% UTC) | | | | IC$_{50}$ μM |
|---|---|---|---|---|---|
| | 47 nM | 188 nM | 750 nM | 3000 nM | |
| 1128795 | 84 | 63 | 38 | 28 | 0.5 |
| 1128796 | 66 | 50 | 21 | 12 | 0.2 |
| 1128797 | 86 | 71 | 37 | 24 | 0.5 |
| 1128802 | 86 | 62 | 37 | 15 | 0.4 |
| 1128836 | 80 | 67 | 44 | 30 | 0.6 |
| 1128878 | 85 | 74 | 50 | 27 | 0.7 |
| 1128958 | 92 | 94 | 74 | 42 | >3.0 |
| 1129058 | 94 | 54 | 45 | 28 | 0.5 |
| 1129136 | 77 | 68 | 62 | 32 | 1.0 |
| 1129477 | 96 | 56 | 39 | 26 | 0.5 |
| 1129478 | 98 | 65 | 37 | 22 | 0.5 |
| 1129496 | 88 | 76 | 70 | 45 | 2.8 |
| 1129497 | 100 | 75 | 43 | 17 | 0.6 |
| 1129498 | 80 | 69 | 43 | 32 | 0.6 |
| 1129499 | 77 | 65 | 31 | 26 | 0.4 |
| 1129516 | 82 | 43 | 38 | 32 | 0.3 |
| 1129537 | 69 | 57 | 21 | 16 | 0.2 |
| 1129538 | 55 | 38 | 18 | 11 | 0.1 |
| 1129539 | 45 | 22 | 14 | 7 | <0.04 |

TABLE 95

Dose-dependent reduction of human FXII RNA by modified oligonucleotides

| Compound Number | FXII (% UTC) 47 nM | 188 nM | 750 nM | 3000 nM | IC$_{50}$ µM |
|---|---|---|---|---|---|
| 1128738 | 88 | 72 | 56 | 32 | 0.9 |
| 1128799 | 92 | 68 | 58 | 22 | 0.7 |
| 1128802 | 104 | 73 | 40 | 23 | 0.6 |
| 1128879 | 81 | 76 | 33 | 23 | 0.5 |
| 1128880 | 97 | 72 | 39 | 25 | 0.6 |
| 1128980 | 112 | 85 | 62 | 42 | 1.7 |
| 1129000 | 118 | 97 | 65 | 38 | 1.7 |
| 1129020 | 106 | 92 | 52 | 35 | 1.2 |
| 1129039 | 84 | 63 | 45 | 24 | 0.5 |
| 1129119 | 108 | 77 | 65 | 35 | 1.3 |
| 1129139 | 78 | 58 | 44 | 19 | 0.4 |
| 1129180 | 97 | 88 | 40 | 34 | 0.9 |
| 1129420 | 88 | 69 | 47 | 33 | 0.8 |
| 1129460 | 86 | 60 | 39 | 24 | 0.4 |
| 1129479 | 98 | 58 | 36 | 17 | 0.4 |
| 1129481 | 79 | 63 | 42 | 31 | 0.5 |
| 1129500 | 82 | 64 | 44 | 18 | 0.4 |
| 1129540 | 48 | 28 | 19 | 11 | <0.04 |
| 1129541 | 64 | 36 | 17 | 10 | 0.1 |

TABLE 96

Dose-dependent reduction of human FXII RNA by modified

| Compound Number | FXII (% UTC) 47 nM | 188 nM | 750 nM | 3000 nM | IC$_{50}$ µM |
|---|---|---|---|---|---|
| 1128762 | 73 | 63 | 37 | 21 | 0.3 |
| 1128801 | 99 | 56 | 35 | 18 | 0.4 |
| 1128802 | 97 | 65 | 37 | 14 | 0.4 |
| 1128821 | 78 | 55 | 57 | 21 | 0.5 |
| 1128841 | 106 | 91 | 73 | 36 | 1.9 |
| 1128881 | 80 | 66 | 42 | 27 | 0.5 |
| 1129022 | 122 | 100 | 80 | 46 | 2.9 |
| 1129043 | 112 | 98 | 57 | 31 | 1.2 |
| 1129142 | 98 | 79 | 48 | 20 | 0.7 |
| 1129221 | 63 | 49 | 28 | 14 | 0.1 |
| 1129423 | 99 | 72 | 36 | 29 | 0.6 |
| 1129441 | 78 | 45 | 27 | 12 | 0.2 |
| 1129462 | 95 | 70 | 64 | 25 | 0.9 |
| 1129482 | 84 | 63 | 70 | 29 | 1.0 |
| 1129483 | 69 | 33 | 14 | 8 | 0.1 |
| 1129501 | 95 | 66 | 35 | 14 | 0.4 |
| 1129502 | 93 | 73 | 49 | 19 | 0.6 |
| 1129542 | 66 | 34 | 24 | 12 | 0.1 |
| 1129543 | 89 | 44 | 30 | 17 | 0.3 |

TABLE 97

Dose-dependent reduction of human FXII RNA by modified oligonucleotides

| Compound Number | FXII (% UTC) 47 nM | 188 nM | 750 nM | 3000 nM | IC$_{50}$ µM |
|---|---|---|---|---|---|
| 1128763 | 80 | 57 | 37 | 22 | 0.3 |
| 1128764 | 73 | 42 | 26 | 12 | 0.2 |
| 1128802 | 68 | 58 | 32 | 19 | 0.2 |
| 1129044 | 88 | 69 | 43 | 26 | 0.6 |
| 1129065 | 85 | 60 | 36 | 15 | 0.4 |
| 1129084 | 87 | 70 | 47 | 23 | 0.6 |
| 1129104 | 103 | 87 | 54 | 40 | 1.4 |
| 1129143 | 81 | 65 | 40 | 24 | 0.4 |
| 1129144 | 98 | 68 | 45 | 30 | 0.7 |
| 1129424 | 95 | 59 | 39 | 24 | 0.5 |
| 1129445 | 83 | 54 | 40 | 20 | 0.4 |
| 1129484 | 61 | 40 | 22 | 15 | 0.1 |
| 1129485 | 55 | 39 | 21 | 10 | 0.1 |
| 1129486 | 57 | 38 | 21 | 9 | 0.1 |
| 1129503 | 114 | 110 | 86 | 43 | >3.0 |
| 1129504 | 100 | 71 | 43 | 26 | 0.7 |
| 1129544 | 82 | 46 | 33 | 18 | 0.3 |
| 1129545 | 70 | 54 | 32 | 15 | 0.2 |
| 1129864 | 89 | 66 | 53 | 31 | 0.8 |

TABLE 98

Dose-dependent reduction of human FXII RNA by modified oligonucleotides

| Compound Number | FXII (% UTC) 47 nM | 188 nM | 750 nM | 3000 nM | IC$_{50}$ µM |
|---|---|---|---|---|---|
| 1128747 | 99 | 95 | 60 | 38 | 1.6 |
| 1128765 | 76 | 48 | 29 | 11 | 0.2 |
| 1128766 | 49 | 52 | 36 | 17 | 0.1 |
| 1128768 | 65 | 53 | 34 | 25 | 0.2 |
| 1128802 | 83 | 55 | 41 | 15 | 0.3 |
| 1128808 | 98 | 85 | 67 | 31 | 1.4 |
| 1128848 | 79 | 59 | 47 | 18 | 0.4 |
| 1129227 | 81 | 60 | 39 | 31 | 0.5 |
| 1129287 | 72 | 72 | 34 | 18 | 0.3 |
| 1129407 | 59 | 51 | 44 | 27 | 0.2 |
| 1129408 | 61 | 58 | 40 | 25 | 0.2 |
| 1129426 | 81 | 68 | 46 | 19 | 0.5 |
| 1129466 | 84 | 55 | 48 | 29 | 0.5 |
| 1129487 | 71 | 56 | 23 | 35 | 0.3 |
| 1129488 | 59 | 49 | 26 | 11 | 0.1 |
| 1129489 | 58 | 42 | 16 | 15 | 0.1 |
| 1129526 | 96 | 79 | 64 | 33 | 1.3 |
| 1129527 | 69 | 58 | 31 | 19 | 0.2 |
| 1129948 | 84 | 65 | 45 | 27 | 0.5 |

TABLE 99

Dose-dependent reduction of human FXII RNA by modified oligonucleotides

| Compound Number | FXII (% UTC) 47 nM | 188 nM | 750 nM | 3000 nM | IC$_{50}$ µM |
|---|---|---|---|---|---|
| 1128769 | 49 | 37 | 24 | 19 | <0.04 |
| 1128802 | 67 | 49 | 25 | 12 | 0.2 |
| 1128810 | 75 | 77 | 43 | 29 | 0.6 |
| 1128830 | 117 | 72 | 33 | 29 | 0.7 |
| 1128870 | 49 | 36 | 38 | 18 | <0.04 |
| 1129051 | 88 | 71 | 52 | 33 | 0.9 |
| 1129092 | 86 | 66 | 43 | 27 | 0.6 |
| 1129211 | 76 | 54 | 57 | 19 | 0.4 |
| 1129409 | 60 | 32 | 34 | 13 | 0.1 |
| 1129472 | 70 | 35 | 42 | 18 | 0.2 |
| 1129490 | 58 | 29 | 13 | 6 | 0.1 |
| 1129491 | 52 | 31 | 22 | 7 | <0.04 |
| 1129492 | 62 | 26 | 10 | 9 | 0.1 |
| 1129510 | 55 | 42 | 42 | 14 | 0.1 |
| 1129529 | 73 | 50 | 44 | 21 | 0.3 |

TABLE 99-continued

Dose-dependent reduction of human FXII RNA by modified oligonucleotides

| Compound Number | FXII (% UTC) 47 nM | 188 nM | 750 nM | 3000 nM | IC$_{50}$ µM |
|---|---|---|---|---|---|
| 1129530 | 66 | 34 | 24 | 9 | 0.1 |
| 1129531 | 48 | 42 | 32 | 10 | <0.04 |
| 1129532 | 55 | 27 | 13 | 8 | <0.04 |
| 1129949 | 84 | 98 | 56 | 42 | 2.0 |

TABLE 100

Dose-dependent reduction of human FXII RNA by modified oligonucleotides

| Compound Number | FXII (% UTC) 78 nM | 313 nM | 1250 nM | 5000 nM | IC$_{50}$ µM |
|---|---|---|---|---|---|
| 1130826 | 88 | 63 | 43 | 14 | 0.7 |
| 1130828 | 73 | 56 | 37 | 23 | 0.5 |
| 1130871 | 65 | 28 | 19 | 18 | 0.1 |
| 1130883 | 94 | 57 | 44 | 21 | 0.8 |
| 1131023 | 89 | 64 | 42 | 22 | 0.8 |
| 1131024 | 92 | 68 | 43 | 31 | 1.1 |
| 1131247 | 107 | 105 | 54 | 34 | 2.3 |
| 1131416 | 81 | 67 | 39 | 23 | 0.7 |
| 1131640 | 97 | 64 | 45 | 20 | 0.9 |
| 1131695 | 78 | 54 | 33 | 21 | 0.5 |
| 1131696 | 100 | 45 | 34 | 14 | 0.6 |
| 1131697 | 70 | 46 | 31 | 7 | 0.3 |
| 1131724 | 96 | 60 | 36 | 37 | 1.0 |
| 1131725 | 83 | 64 | 45 | 17 | 0.7 |
| 1131751 | 88 | 54 | 34 | 15 | 0.5 |
| 1131752 | 75 | 49 | 40 | 21 | 0.5 |
| 1131753 | 61 | 38 | 20 | 8 | 0.1 |
| 1131891 | 80 | 46 | 37 | 13 | 0.4 |
| 1131892 | 77 | 84 | 61 | 33 | 2.1 |

TABLE 101

Dose-dependent reduction of human FXII RNA by modified oligonucleotides

| Compound Number | FXII (% UTC) 78 nM | 313 nM | 1250 nM | 5000 nM | IC$_{50}$ µM |
|---|---|---|---|---|---|
| 1130829 | 78 | 62 | 28 | 18 | 0.5 |
| 1130830 | 92 | 49 | 26 | 25 | 0.6 |
| 1130871 | 75 | 53 | 27 | 15 | 0.4 |
| 1130914 | 100 | 86 | 73 | 43 | 4.2 |
| 1130970 | 88 | 84 | 63 | 39 | 3.0 |
| 1130997 | 87 | 73 | 57 | 24 | 1.2 |
| 1130998 | 92 | 76 | 61 | 45 | 3.4 |
| 1131025 | 71 | 76 | 42 | 20 | 0.7 |
| 1131053 | 84 | 85 | 55 | 32 | 1.8 |
| 1131473 | 90 | 74 | 35 | 19 | 0.8 |
| 1131474 | 94 | 77 | 55 | 36 | 1.9 |
| 1131641 | 82 | 69 | 43 | 23 | 0.8 |
| 1131671 | 61 | 49 | 35 | 21 | 0.3 |
| 1131698 | 88 | 87 | 48 | 14 | 1.0 |
| 1131699 | 73 | 43 | 24 | 11 | 0.3 |
| 1131754 | 48 | 22 | 14 | 7 | <0.1 |
| 1131755 | 61 | 41 | 18 | 5 | 0.2 |
| 1132453 | 96 | 74 | 55 | 23 | 1.2 |
| 1132537 | 88 | 65 | 46 | 22 | 0.9 |

TABLE 102

Dose-dependent reduction of human FXII RNA by modified oligonucleotides

| Compound Number | FXII (% UTC) 78 nM | 313 nM | 1250 nM | 5000 nM | IC$_{50}$ µM |
|---|---|---|---|---|---|
| 1130831 | 68 | 50 | 20 | 11 | 0.3 |
| 1130832 | 77 | 55 | 35 | 21 | 0.5 |
| 1130858 | 80 | 88 | 55 | 35 | 2.0 |
| 1130871 | 72 | 37 | 24 | 16 | 0.2 |
| 1130973 | 85 | 61 | 45 | 22 | 0.8 |
| 1131084 | 85 | 95 | 49 | 27 | 1.5 |
| 1131198 | 85 | 68 | 38 | 24 | 0.8 |
| 1131223 | 91 | 53 | 41 | 16 | 0.6 |
| 1131309 | 87 | 64 | 34 | 42 | 1.1 |
| 1131310 | 86 | 62 | 51 | 28 | 1.1 |
| 1131700 | 67 | 45 | 29 | 9 | 0.2 |
| 1131701 | 55 | 48 | 26 | 5 | 0.2 |
| 1131702 | 96 | 42 | 16 | 9 | 0.4 |
| 1131730 | 93 | 64 | 38 | 32 | 1.0 |
| 1131756 | 39 | 13 | 13 | 5 | 0.1 |
| 1131757 | 54 | 27 | 14 | 10 | 0.1 |
| 1131758 | 73 | 58 | 25 | 9 | 0.4 |
| 1132455 | 88 | 74 | 59 | 33 | 1.8 |
| 1132651 | 76 | 76 | 55 | 38 | 2.0 |

TABLE 103

Dose-dependent reduction of human FXII RNA by modified oligonucleotides

| Compound Number | FXII (% UTC) 78 nM | 313 nM | 1250 nM | 5000 nM | IC$_{50}$ µM |
|---|---|---|---|---|---|
| 1130871 | 65 | 52 | 30 | 22 | 0.3 |
| 1130894 | 72 | 66 | 50 | 38 | 1.3 |
| 1131006 | 100 | 92 | 68 | 47 | 4.8 |
| 1131146 | 84 | 91 | 56 | 37 | 2.4 |
| 1131199 | 76 | 75 | 54 | 22 | 1.0 |
| 1131255 | 83 | 65 | 53 | 19 | 0.9 |
| 1131314 | 77 | 71 | 61 | 34 | 1.9 |
| 1131337 | 70 | 81 | 57 | 36 | 2.1 |
| 1131423 | 74 | 64 | 40 | 21 | 0.6 |
| 1131426 | 98 | 87 | 81 | 44 | >5.0 |
| 1131481 | 91 | 66 | 43 | 28 | 1.0 |
| 1131593 | 66 | 51 | 37 | 26 | 0.4 |
| 1131673 | 93 | 63 | 45 | 35 | 1.2 |
| 1131704 | 96 | 45 | 39 | 19 | 0.6 |
| 1131706 | 93 | 80 | 62 | 40 | 2.7 |
| 1131759 | 62 | 67 | 40 | 23 | 0.5 |
| 1131760 | 87 | 71 | 55 | 40 | 2.0 |
| 1131761 | 89 | 75 | 60 | 29 | 1.6 |
| 1132797 | 100 | 75 | 77 | 54 | >5.0 |

TABLE 104

Dose-dependent reduction of human FXII RNA by modified oligonucleotides

| Compound Number | FXII (% UTC) 78 nM | 313 nM | 1250 nM | 5000 nM | IC$_{50}$ µM |
|---|---|---|---|---|---|
| 1130839 | 141 | 86 | 58 | 32 | 2.0 |
| 1130871 | 57 | 34 | 22 | 9 | 0.1 |
| 1130920 | 89 | 83 | 76 | 23 | 2.1 |
| 1130952 | 94 | 71 | 49 | 29 | 1.3 |
| 1130979 | 81 | 84 | 68 | 34 | 2.7 |
| 1131007 | 104 | 73 | 61 | 43 | 2.6 |
| 1131120 | 108 | 68 | 44 | 42 | 1.6 |

TABLE 104-continued

Dose-dependent reduction of human FXII RNA by modified oligonucleotides

| Compound Number | 78 nM | 313 nM | 1250 nM | 5000 nM | IC$_{50}$ μM |
|---|---|---|---|---|---|
| 1131204 | 71 | 50 | 27 | 26 | 0.4 |
| 1131340 | 92 | 78 | 63 | 27 | 1.7 |
| 1131344 | 88 | 69 | 44 | 35 | 1.2 |
| 1131368 | 87 | 79 | 63 | 41 | 3.0 |
| 1131424 | 74 | 79 | 47 | 33 | 1.3 |
| 1131428 | 99 | 64 | 47 | 21 | 0.9 |
| 1131480 | 82 | 60 | 57 | 17 | 0.8 |
| 1131484 | 85 | 67 | 46 | 24 | 0.9 |
| 1131595 | 67 | 48 | 35 | 23 | 0.3 |
| 1131736 | 79 | 78 | 40 | 14 | 0.7 |
| 1131763 | 49 | 38 | 22 | 15 | <0.1 |
| 1131764 | 59 | 44 | 25 | 15 | 0.2 |

TABLE 105

Dose-dependent reduction of human FXII RNA by modified oligonucleotides

| Compound Number | 78 nM | 313 nM | 1250 nM | 5000 nM | IC$_{50}$ μM |
|---|---|---|---|---|---|
| 1130840 | 76 | 69 | 46 | 27 | 0.9 |
| 1130868 | 54 | 49 | 33 | 13 | 0.2 |
| 1130870 | 76 | 57 | 48 | 18 | 0.6 |
| 1130871 | 72 | 41 | 29 | 18 | 0.3 |
| 1130925 | 70 | 60 | 31 | 19 | 0.4 |
| 1130981 | 86 | 62 | 42 | 23 | 0.8 |
| 1130983 | 88 | 62 | 43 | 29 | 0.9 |
| 1131009 | 92 | 91 | 50 | 35 | 1.9 |
| 1131036 | 83 | 72 | 59 | 32 | 1.7 |
| 1131095 | 74 | 59 | 31 | 34 | 0.6 |
| 1131375 | 91 | 89 | 67 | 46 | 4.9 |
| 1131429 | 75 | 61 | 45 | 24 | 0.7 |
| 1131624 | 72 | 56 | 49 | 22 | 0.6 |
| 1131625 | 61 | 72 | 43 | 22 | 0.6 |
| 1131627 | 91 | 58 | 42 | 20 | 0.7 |
| 1131711 | 94 | 100 | 53 | 30 | 1.9 |
| 1131737 | 79 | 62 | 42 | 19 | 0.6 |
| 1131739 | 94 | 80 | 58 | 31 | 1.8 |
| 1131767 | 82 | 50 | 42 | 34 | 0.8 |

TABLE 106

Dose-dependent reduction of human FXII RNA by modified oligonucleotides

| Compound Number | 78 nM | 313 nM | 1250 nM | 5000 nM | IC$_{50}$ μM |
|---|---|---|---|---|---|
| 1130871 | 59 | 39 | 23 | 11 | 0.1 |
| 1130872 | 77 | 59 | 31 | 38 | 0.7 |
| 1130900 | 57 | 50 | 51 | 23 | 0.3 |
| 1130928 | 76 | 53 | 57 | 55 | >5.0 |
| 1131013 | 75 | 58 | 25 | 16 | 0.4 |
| 1131040 | 61 | 57 | 43 | 23 | 0.4 |
| 1131096 | 82 | 70 | 39 | 35 | 1.1 |
| 1131208 | 102 | 80 | 57 | 33 | 1.9 |
| 1131347 | 86 | 67 | 63 | 31 | 1.7 |
| 1131348 | 74 | 67 | 42 | 29 | 0.8 |
| 1131432 | 61 | 45 | 34 | 22 | 0.2 |
| 1131433 | 91 | 63 | 28 | 20 | 0.6 |
| 1131599 | 70 | 61 | 37 | 23 | 0.5 |
| 1131601 | 88 | 58 | 49 | 34 | 1.1 |
| 1131630 | 93 | 54 | 42 | 20 | 0.7 |
| 1131712 | 73 | 54 | 32 | 22 | 0.4 |
| 1131713 | 101 | 66 | 33 | 27 | 0.9 |
| 1132188 | 89 | 75 | 69 | 41 | 3.4 |
| 1132271 | 80 | 76 | 68 | 48 | >5.0 |

TABLE 107

Dose-dependent reduction of human FXII RNA by modified oligonucleotides

| Compound Number | 78 nM | 313 nM | 1250 nM | 5000 nM | IC$_{50}$ μM |
|---|---|---|---|---|---|
| 1130763 | 91 | 71 | 50 | 44 | 2.1 |
| 1130846 | 64 | 56 | 42 | 37 | 0.6 |
| 1130871 | 63 | 41 | 19 | 16 | 0.2 |
| 1130874 | 69 | 74 | 40 | 24 | 0.7 |
| 1130903 | 119 | 90 | 65 | 35 | 2.4 |
| 1130987 | 66 | 39 | 27 | 17 | 0.2 |
| 1131015 | 80 | 84 | 65 | 33 | 2.4 |
| 1131126 | 66 | 77 | 51 | 28 | 1.1 |
| 1131155 | 87 | 79 | 61 | 31 | 1.9 |
| 1131350 | 79 | 66 | 46 | 30 | 1.0 |
| 1131434 | 83 | 56 | 40 | 23 | 0.6 |
| 1131462 | 73 | 73 | 56 | 34 | 1.6 |
| 1131463 | 98 | 104 | 77 | 45 | >5.0 |
| 1131686 | 71 | 53 | 48 | 29 | 0.7 |
| 1131687 | 78 | 60 | 42 | 29 | 0.8 |
| 1131688 | 74 | 57 | 34 | 23 | 0.5 |
| 1131716 | 100 | 58 | 43 | 23 | 0.9 |
| 1131744 | 78 | 67 | 32 | 58 | 2.2 |
| 1132387 | 104 | 96 | 77 | 51 | >5.0 |

TABLE 108

Dose-dependent reduction of human FXII RNA by modified oligonucleotides

| Compound Number | 78 nM | 313 nM | 1250 nM | 5000 nM | IC$_{50}$ μM |
|---|---|---|---|---|---|
| 1130871 | 69.8 | 45.8 | 26.5 | 23.1 | 0.3 |
| 1130988 | 76.2 | 74.4 | 49.9 | 24.9 | 1.0 |
| 1131018 | 92.2 | 62.8 | 43.5 | 20.2 | 0.8 |
| 1131019 | 90.5 | 78.4 | 36.3 | 20.4 | 0.9 |
| 1131100 | 90.3 | 69.0 | 47.3 | 29.5 | 1.2 |
| 1131242 | 85.1 | 59.3 | 45.8 | 19.2 | 0.7 |
| 1131243 | 84.3 | 70.1 | 49.8 | 23.1 | 1.0 |
| 1131409 | 85.6 | 82.4 | 46.3 | 26.1 | 1.2 |
| 1131411 | 95.8 | 87.5 | 48.1 | 39.4 | 2.0 |
| 1131605 | 77.7 | 80.7 | 44.5 | 25.8 | 1.0 |
| 1131635 | 80.9 | 50.2 | 44.3 | 28.5 | 0.7 |
| 1131663 | 80.0 | 74.7 | 44.0 | 17.3 | 0.8 |
| 1131689 | 92.7 | 72.3 | 64.7 | 27.1 | 1.6 |
| 1131691 | 76.5 | 55.0 | 35.1 | 16.4 | 0.5 |
| 1131717 | 85.2 | 58.3 | 39.3 | 23.6 | 0.7 |
| 1131718 | 94.4 | 63.5 | 47.4 | 33.6 | 1.2 |
| 1131745 | 73.3 | 49.4 | 32.1 | 25.7 | 0.4 |
| 1131746 | 81.7 | 54.2 | 39.0 | 15.6 | 0.5 |
| 1131747 | 69.9 | 48.1 | 33.6 | 18.1 | 0.3 |

TABLE 109

Dose-dependent reduction of human FXII RNA by modified oligonucleotides

| Compound Number | FXII (% UTC) 78 nM | 313 nM | 1250 nM | 5000 nM | $IC_{50}$ µM |
|---|---|---|---|---|---|
| 1130824 | 86 | 73 | 56 | 29 | 1.4 |
| 1130825 | 111 | 78 | 49 | 42 | 2.0 |
| 1130871 | 76 | 39 | 26 | 17 | 0.3 |
| 1130908 | 76 | 65 | 51 | 28 | 1.0 |
| 1130938 | 97 | 77 | 57 | 19 | 1.2 |
| 1131020 | 79 | 62 | 47 | 15 | 0.6 |
| 1131021 | 77 | 72 | 51 | 27 | 1.1 |
| 1131216 | 78 | 87 | 56 | 55 | >5.0 |
| 1131357 | 90 | 84 | 64 | 38 | 2.8 |
| 1131608 | 100 | 70 | 51 | 30 | 1.4 |
| 1131692 | 70 | 63 | 33 | 22 | 0.5 |
| 1131693 | 63 | 41 | 29 | 18 | 0.2 |
| 1131694 | 79 | 57 | 21 | 16 | 0.4 |
| 1131720 | 92 | 63 | 72 | 27 | 1.7 |
| 1131721 | 92 | 85 | 67 | 40 | 3.3 |
| 1131722 | 106 | 95 | 56 | 40 | 2.6 |
| 1131748 | 75 | 57 | 53 | 20 | 0.7 |
| 1131749 | 90 | 66 | 47 | 25 | 1.0 |
| 1132505 | 85 | 78 | 50 | 36 | 1.7 |

TABLE 110

Dose-dependent reduction of human FXII RNA by modified oligonucleotides

| Compound Number | FXII (% UTC) 78 nM | 313 nM | 1250 nM | 5000 nM | $IC_{50}$ µM |
|---|---|---|---|---|---|
| 413643 | 71 | 57 | 28 | 26 | 0.4 |
| 462073 | 94 | 68 | 30 | 23 | 0.8 |
| 462192 | 64 | 50 | 41 | 16 | 0.3 |
| 626671 | 101 | 98 | 74 | 45 | >5.0 |
| 1124324 | 97 | 87 | 102 | 52 | >5.0 |
| 1124408 | 103 | 74 | 50 | 22 | 1.2 |
| 1124489 | 86 | 84 | 75 | 56 | >5.0 |
| 1124490 | 98 | 83 | 58 | 44 | 3.0 |
| 1124620 | 91 | 74 | 55 | 33 | 1.6 |
| 1124621 | 93 | 74 | 45 | 21 | 1.0 |
| 1124677 | 112 | 83 | 66 | 48 | 3.8 |
| 1124813 | 102 | 86 | 55 | 39 | 2.3 |
| 1124996 | 93 | 62 | 49 | 32 | 1.2 |
| 1125047 | 72 | 63 | 59 | 24 | 1.0 |
| 1125074 | 92 | 70 | 56 | 39 | 2.0 |
| 1125075 | 100 | 94 | 58 | 51 | >5.0 |
| 1125101 | 120 | 108 | 50 | 43 | 2.7 |
| 1125102 | 105 | 61 | 57 | 45 | 2.3 |
| 1125570 | 115 | 113 | 115 | 81 | >5.0 |

TABLE 111

Dose-dependent reduction of human FXII RNA by modified oligonucleotides

| Compound Number | FXII (% UTC) 78 nM | 313 nM | 1250 nM | 5000 nM | $IC_{50}$ µM |
|---|---|---|---|---|---|
| 413644 | 129 | 90 | 69 | 36 | 2.6 |
| 462073 | 117 | 78 | 46 | 36 | 1.6 |
| 1124222 | 490 | 74 | 81 | 51 | >5.0 |
| 1124223 | 93 | 84 | 66 | 51 | >5.0 |
| 1124328 | 129 | 93 | 82 | 42 | 4.0 |
| 1124384 | 80 | 101 | 79 | 59 | >5.0 |
| 1124491 | 76 | 78 | 52 | 35 | 1.6 |
| 1124598 | 100 | 87 | 91 | 51 | >5.0 |
| 1124842 | 105 | 93 | 65 | 56 | >5.0 |
| 1124998 | 122 | 77 | 67 | 41 | 2.7 |
| 1125023 | 96 | 91 | 53 | 36 | 2.1 |
| 1125049 | 105 | 91 | 56 | 43 | 2.7 |
| 1125050 | 100 | 78 | 67 | 29 | 1.9 |
| 1125051 | 80 | 58 | 39 | 19 | 0.6 |
| 1125076 | 103 | 96 | 83 | 51 | >5.0 |
| 1125077 | 106 | 99 | 74 | 42 | 4.4 |
| 1125078 | 94 | 92 | 87 | 40 | >5.0 |
| 1125103 | 99 | 116 | 65 | 37 | 3.5 |
| 1125104 | 115 | 94 | 49 | 55 | 3.5 |

TABLE 112

Dose-dependent reduction of human FXII RNA by modified oligonucleotides

| Compound Number | FXII (% UTC) 63 nM | 250 nM | 1000 nM | 4000 nM | $IC_{50}$ µM |
|---|---|---|---|---|---|
| 1129531 | 78 | 53 | 26 | 11 | 0.3 |
| 1206486 | 82 | 65 | 51 | 31 | 0.9 |
| 1206977 | 92 | 69 | 50 | 23 | 0.8 |
| 1206981 | 79 | 66 | 45 | 25 | 0.7 |
| 1207005 | 67 | 41 | 17 | 13 | 0.2 |
| 1207007 | 51 | 31 | 15 | 6 | <0.1 |
| 1207009 | 90 | 65 | 38 | 26 | 0.7 |
| 1207111 | 87 | 56 | 44 | 22 | 0.6 |
| 1207113 | 92 | 73 | 45 | 26 | 0.9 |
| 1207133 | 72 | 48 | 29 | 18 | 0.3 |
| 1207164 | 77 | 76 | 52 | 36 | 1.3 |
| 1207228 | 87 | 65 | 53 | 37 | 1.2 |
| 1207230 | 106 | 77 | 63 | 60 | >4.0 |
| 1207244 | 91 | 57 | 46 | 24 | 0.7 |
| 1207276 | 63 | 39 | 11 | 11 | 0.1 |
| 1207362 | 75 | 71 | 48 | 20 | 0.6 |
| 1207366 | 94 | 53 | 38 | 24 | 0.6 |
| 1207370 | 68 | 55 | 39 | 21 | 0.3 |
| 1207394 | 61 | 39 | 22 | 11 | 0.1 |

TABLE 113

Dose-dependent reduction of human FXII RNA by modified oligonucleotides

| Compound Number | FXII (% UTC) 63 nM | 250 nM | 1000 nM | 4000 nM | $IC_{50}$ µM |
|---|---|---|---|---|---|
| 1129531 | 92 | 47 | 28 | 14 | 0.4 |
| 1206487 | 82 | 68 | 54 | 29 | 1 |
| 1206497 | 99 | 70 | 58 | 31 | 1.3 |
| 1206970 | 77 | 54 | 35 | 12 | 0.4 |
| 1206978 | 93 | 63 | 35 | 15 | 0.5 |
| 1206986 | 91 | 71 | 52 | 36 | 1.3 |
| 1207010 | 76 | 51 | 17 | 7 | 0.2 |
| 1207106 | 84 | 65 | 49 | 19 | 0.7 |
| 1207125 | 91 | 52 | 28 | 8 | 0.4 |
| 1207159 | 71 | 36 | 14 | 6 | 0.2 |
| 1207190 | 78 | 61 | 59 | 31 | 1 |
| 1207247 | 101 | 70 | 28 | 16 | 0.6 |
| 1207254 | 71 | 49 | 29 | 18 | 0.3 |
| 1207255 | 71 | 49 | 28 | 21 | 0.3 |

TABLE 113-continued

Dose-dependent reduction of human FXII RNA by modified oligonucleotides

| Compound Number | FXII (% UTC) | | | | IC$_{50}$ µM |
|---|---|---|---|---|---|
| | 63 nM | 250 nM | 1000 nM | 4000 nM | |
| 1207271 | 113 | 80 | 55 | 29 | 1.3 |
| 1207278 | 46 | 36 | 11 | 4 | <0.1 |
| 1207279 | 66 | 38 | 23 | 10 | 0.2 |
| 1207358 | 78 | 61 | 43 | 17 | 0.5 |
| 1207367 | 79 | 48 | 30 | 9 | 0.3 |

TABLE 114

Dose-dependent reduction of human FXII RNA by modified oligonucleotides

| Compound Number | FXII (% UTC) | | | | IC$_{50}$ µM |
|---|---|---|---|---|---|
| | 63 nM | 250 nM | 1000 nM | 4000 nM | |
| 1129531 | 57 | 40 | 17 | 7 | 0.1 |
| 1206490 | 72 | 42 | 35 | 24 | 0.3 |
| 1206492 | 73 | 60 | 46 | 22 | 0.5 |
| 1206980 | 68 | 51 | 34 | 13 | 0.3 |
| 1206996 | 76 | 54 | 30 | 20 | 0.4 |
| 1207004 | 66 | 57 | 41 | 30 | 0.4 |
| 1207006 | 47 | 19 | 10 | 7 | <0.1 |
| 1207118 | 73 | 53 | 31 | 14 | 0.3 |
| 1213120 | 60 | 45 | 24 | 15 | 0.1 |
| 1213135 | 70 | 53 | 31 | 23 | 0.3 |
| 1213144 | 42 | 20 | 25 | 6 | <0.1 |
| 1213220 | 58 | 53 | 41 | 33 | 0.3 |
| 1213227 | 78 | 72 | 40 | 27 | 0.7 |
| 1213234 | 80 | 64 | 44 | 25 | 0.6 |
| 1213235 | 66 | 59 | 30 | 18 | 0.3 |
| 1213259 | 52 | 29 | 16 | 9 | <0.1 |
| 1213260 | 51 | 35 | 13 | 13 | <0.1 |
| 1213262 | 56 | 27 | 18 | 9 | <0.1 |
| 1213264 | 77 | 46 | 18 | 9 | 0.2 |

TABLE 115

Dose-dependent reduction of human FXII RNA by modified oligonucleotides

| Compound Number | FXII (% UTC) | | | | IC$_{50}$ µM |
|---|---|---|---|---|---|
| | 63 nM | 250 nM | 1000 nM | 4000 nM | |
| 1129531 | 77 | 44 | 20 | 20 | 0.2 |
| 1206489 | 83 | 53 | 35 | 21 | 0.4 |
| 1206509 | 97 | 89 | 72 | 33 | 2.3 |
| 1206971 | 84 | 65 | 38 | 22 | 0.6 |
| 1206972 | 69 | 70 | 49 | 21 | 0.6 |
| 1206984 | 64 | 51 | 37 | 25 | 0.3 |
| 1206987 | 70 | 82 | 64 | 47 | >4.0 |
| 1207008 | 58 | 37 | 18 | 14 | 0.1 |
| 1207123 | 96 | 73 | 59 | 26 | 1.1 |
| 1207131 | 79 | 57 | 45 | 27 | 0.6 |
| 1207139 | 86 | 66 | 54 | 24 | 0.9 |
| 1207160 | 53 | 27 | 13 | 11 | <0.1 |
| 1207161 | 53 | 31 | 16 | 13 | <0.1 |
| 1207248 | 83 | 58 | 43 | 31 | 0.7 |
| 1207277 | 42 | 28 | 12 | 6 | <0.1 |
| 1207312 | 85 | 75 | 39 | 23 | 0.7 |
| 1207360 | 80 | 48 | 39 | 22 | 0.4 |
| 1207381 | 79 | 85 | 61 | 46 | 3.6 |
| 1207393 | 58 | 38 | 17 | 7 | 0.1 |

TABLE 116

Dose-dependent reduction of human FXII RNA by modified oligonucleotides

| Compound Number | FXII (% UTC) | | | | IC$_{50}$ µM |
|---|---|---|---|---|---|
| | 63 nM | 250 nM | 1000 nM | 4000 nM | |
| 1128802 | 88 | 57 | 36 | 17 | 0.5 |
| 1129531 | 68 | 44 | 30 | 14 | 0.2 |
| 1208476 | 71 | 62 | 35 | 23 | 0.4 |
| 1208506 | 80 | 80 | 77 | 67 | >4.0 |
| 1208689 | 84 | 76 | 66 | 76 | >4.0 |
| 1208937 | 92 | 85 | 83 | 69 | >4.0 |
| 1209017 | 80 | 73 | 72 | 59 | >4.0 |
| 1209119 | 80 | 66 | 72 | 59 | >4.0 |
| 1209422 | 94 | 90 | 54 | 61 | >4.0 |
| 1209543 | 91 | 94 | 83 | 76 | >4.0 |
| 1209545 | 88 | 82 | 71 | 70 | >4.0 |
| 1209565 | 98 | 95 | 70 | 78 | >4.0 |
| 1209576 | 82 | 83 | 68 | 60 | >4.0 |
| 1209607 | 93 | 88 | 74 | 85 | >4.0 |
| 1209615 | 97 | 83 | 68 | 71 | >4.0 |
| 1209616 | 82 | 76 | 70 | 60 | >4.0 |
| 1209630 | 92 | 86 | 83 | 71 | >4.0 |
| 1209659 | 91 | 98 | 67 | 57 | >4.0 |
| 1209674 | 99 | 81 | 81 | 70 | >4.0 |

TABLE 117

Dose-dependent reduction of human FXII RNA by modified oligonucleotides

| Compound Number | FXII (% UTC) | | | | IC$_{50}$ µM |
|---|---|---|---|---|---|
| | 63 nM | 250 nM | 1000 nM | 4000 nM | |
| 1128802 | 82 | 55 | 38 | 16 | 0.4 |
| 1129531 | 77 | 38 | 29 | 9 | 0.2 |
| 1208612 | 83 | 79 | 63 | 58 | >4.0 |
| 1208757 | 84 | 76 | 74 | 69 | >4.0 |
| 1208977 | 76 | 75 | 76 | 43 | >4.0 |
| 1209134 | 81 | 78 | 75 | 72 | >4.0 |
| 1209238 | 76 | 73 | 68 | 71 | >4.0 |
| 1209391 | 91 | 100 | 89 | 78 | >4.0 |
| 1209430 | 84 | 77 | 73 | 54 | >4.0 |
| 1209455 | 77 | 74 | 71 | 71 | >4.0 |
| 1209514 | 76 | 77 | 70 | 73 | >4.0 |
| 1209547 | 89 | 78 | 58 | 35 | 1.6 |
| 1209548 | 81 | 74 | 59 | 35 | 1.5 |
| 1209605 | 103 | 100 | 78 | 80 | >4.0 |
| 1209624 | 89 | 90 | 75 | 70 | >4.0 |
| 1209645 | 105 | 85 | 79 | 62 | >4.0 |
| 1209670 | 115 | 96 | 82 | 85 | >4.0 |
| 1209688 | 78 | 75 | 80 | 76 | >4.0 |
| 1209692 | 88 | 97 | 89 | 71 | >4.0 |

Example 8: Design of Oligomeric Compounds Complementary to a Human FXII Nucleic Acid Oligomeric compounds were designed as indicated in the tables below. Modified oligonucleotides described in the Examples above (parent compounds) were further modified by either adding a THA-C6-GalNAc3 conjugate (designated as [THA-GalNAc] in the table below) at the 5' end of the modified oligonucleotide, or by adding a 3'-THA-C6-GalNAc hydroxyproline PO conjugate (designated as 3'-HPPO-GalNAc in the tables below), at the 3'-end of the modified oligonucleotide. THA-GalNAc is represented by the structure below wherein the phosphate group is attached to the 5'-oxygen atom of the 5' nucleoside:

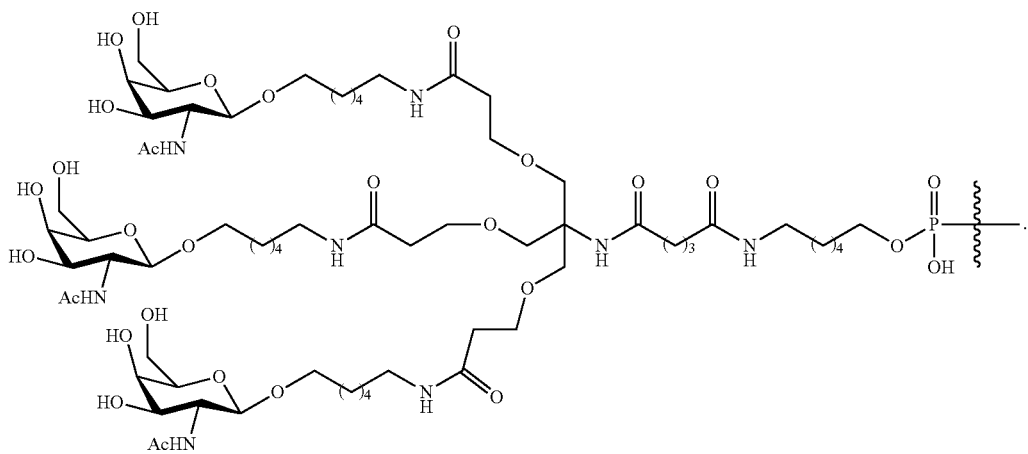

3'-HPPO-GalNAc is represented by the structure below wherein the phosphate group is attached to the 3'-oxygen atom of the 3' nucleoside:

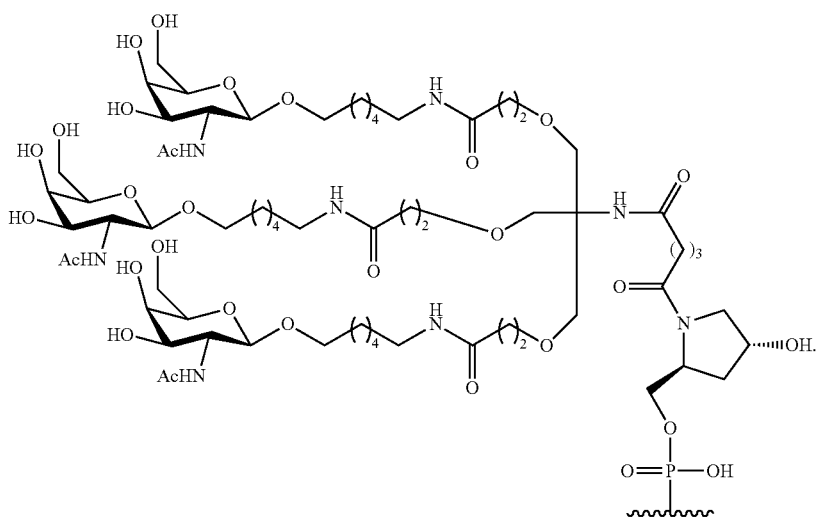

The chemistry notation column in the tables below specifies the specific chemistry notation for modified oligonucleotides; wherein subscript 'd' represents a 2'-β-D-deoxyribosyl sugar moiety, subscript 'e' represents a 2'-MOE sugar moiety, subscript 'y' represents a 2'-O-methyl sugar moiety, subscript 'k' represents a cEt modified sugar moiety, subscript 's' represents a phosphorothioate internucleoside linkage, subscript 'o' represents a phosphodiester internucleoside linkage, and superscript 'm' before the cytosine residue ($^{m}C$) represents a 5-methyl cytosine.

TABLE 118

Design of GalNAc conjugated modified oligonucleotides complementary to human FXII

| Compound No. | Parent Compound No. | Sequence and Chemistry notation (5' to 3') | SEQ ID No. |
|---|---|---|---|
| 1194343 | 1128769 | THA-GalNAc-$_{o}A_{ks}G_{ks}A_{ks}A_{ds}{}^{m}C_{ds}G_{ds}A_{ds}{}^{m}C_{ds}T_{ds}G_{ds}T_{ds}G_{ds}T_{ds}G_{ks}{}^{m}C_{ks}T_{k}$ | 3723 |
| 1194345 | 1128801 | THA-GalNAc-$_{o}A_{ks}{}^{m}C_{ks}A_{ks}T_{ds}T_{ds}T_{ds}G_{ds}T_{ds}G_{ds}G_{ds}T_{ds}A_{ds}{}^{m}C_{ds}A_{ks}G_{ks}{}^{m}C_{k}$ | 3114 |
| 1194346 | 1128802 | THA-GalNAc-$_{o}T_{ks}A_{ks}{}^{m}C_{ks}A_{ds}T_{ds}T_{ds}T_{ds}G_{ds}T_{ds}G_{ds}G_{ds}T_{ds}A_{ds}{}^{m}C_{ks}A_{ks}G_{k}$ | 2426 |
| 1194347 | 1128870 | THA-GalNAc-$_{o}T_{ks}G_{ks}T_{ks}G_{ds}G_{ds}A_{ds}A_{ds}A_{ds}A_{ds}A_{ds}{}^{m}C_{ds}{}^{m}C_{ds}G_{ds}G_{ks}A_{ks}G_{k}$ | 3728 |
| 1194348 | 1129221 | THA-GalNAc-$_{o}{}^{m}C_{ks}G_{ks}T_{ks}{}^{m}C_{ds}T_{ds}G_{ds}G_{ds}{}^{m}C_{ds}A_{ds}{}^{m}C_{ds}G_{ds}G_{ds}{}^{m}C_{ds}T_{ks}{}^{m}C_{ks}A_{k}$ | 3060 |

TABLE 118-continued

Design of GalNAc conjugated modified oligonucleotides complementary to human FXII

| Compound No. | Parent Compound No. | Sequence and Chemistry notation (5' to 3') | SEQ ID No. |
|---|---|---|---|
| 1194349 | 1129287 | THA-GalNAc-$_o{}^mC_{ks}G_{ks}T_{ks}A_{ds}A_{ds}G_{ds}G_{ds}{}^mC_{ds}G_{ds}A_{ds}{}^mC_{ds}A_{ds}G_{ds}G_{ks}A_{ks}G_k$ | 3521 |
| 1194350 | 1129407 | THA-GalNAc-$_oT_{ks}G_{ks}{}^mC_{ks}{}^mC_{ds}T_{ds}T_{ds}G_{ds}{}^mC_{ds}A_{ds}G_{ds}G_{ds}T_{ds}G_{ks}A_{ks}G_k$ | 3527 |
| 1194357 | 1129485 | THA-GalNAc-$_oG_{ks}{}^mC_{ks}G_{ks}G_{ds}A_{ds}A_{ds}T_{ds}{}^mC_{ds}A_{ds}{}^mC_{ds}{}^mC_{ds}A_{ds}A_{ds}G_{ks}G_{ks}A_k$ | 3379 |
| 1194358 | 1129486 | THA-GalNAc-$_oT_{ks}G_{ks}{}^mC_{ks}G_{ds}G_{ds}A_{ds}A_{ds}T_{ds}{}^mC_{ds}A_{ds}{}^mC_{ds}{}^mC_{ds}A_{ds}A_{ks}G_{ks}G_k$ | 3455 |
| 1194359 | 1129487 | THA-GalNAc-$_o{}^mC_{ks}T_{ks}G_{ks}{}^mC_{ds}G_{ds}G_{ds}A_{ds}A_{ds}T_{ds}{}^mC_{ds}A_{ds}{}^mC_{ds}{}^mC_{ds}A_{ks}A_{ks}G_k$ | 3531 |
| 1194360 | 1129488 | THA-GalNAc-$_oA_{ks}{}^mC_{ks}T_{ks}G_{ds}{}^mC_{ds}G_{ds}G_{ds}A_{ds}A_{ds}T_{ds}{}^mC_{ds}A_{ds}{}^mC_{ds}{}^mC_{ks}A_{ks}A_k$ | 3607 |
| 1194361 | 1129489 | THA-GalNAc-$_o{}^mC_{ks}A_{ks}{}^mC_{ks}T_{ds}G_{ds}{}^mC_{ds}G_{ds}G_{ds}A_{ds}A_{ds}T_{ds}{}^mC_{ds}A_{ds}{}^mC_{ks}{}^mC_{ks}A_k$ | 3683 |
| 1194363 | 1129492 | THA-GalNAc-$_oT_{ks}{}^mC_{ks}T_{ks}{}^mC_{ds}A_{ds}{}^mC_{ds}T_{ds}G_{ds}{}^mC_{ds}G_{ds}G_{ds}A_{ds}A_{ds}T_{ks}{}^mC_{ks}A_k$ | 3911 |
| 1194370 | 1129534 | THA-GalNAc-$_oA_{ks}T_{ks}T_{ks}G_{ds}A_{ds}G_{ds}T_{ds}T_{ds}{}^mC_{ds}{}^mC_{ds}T_{ds}G_{ds}{}^mC_{ds}G_{ks}{}^mC_{ks}{}^mC_k$ | 2540 |
| 1194371 | 1129538 | THA-GalNAc-$_oA_{ks}{}^mC_{ks}T_{ks}T_{ds}T_{ds}A_{ds}T_{ds}T_{ds}G_{ds}A_{ds}G_{ds}T_{ds}T_{ds}{}^mC_{ks}{}^mC_{ks}T_k$ | 2848 |
| 1194372 | 1129540 | THA-GalNAc-$_oG_{ks}{}^mC_{ks}A_{ks}{}^mC_{ds}T_{ds}T_{ds}T_{ds}A_{ds}T_{ds}T_{ds}G_{ds}A_{ds}G_{ds}T_{ks}T_{ks}{}^mC_k$ | 3000 |
| 1194373 | 1129542 | THA-GalNAc-$_oA_{ks}A_{ks}G_{ks}{}^mC_{ds}A_{ds}{}^mC_{ds}T_{ds}T_{ds}T_{ds}A_{ds}T_{ds}T_{ds}G_{ds}A_{ks}G_{ks}T_k$ | 3147 |
| 1194374 | 1129543 | THA-GalNAc-$_oA_{ks}A_{ks}A_{ks}G_{ds}{}^mC_{ds}A_{ds}{}^mC_{ds}T_{ds}T_{ds}T_{ds}A_{ds}T_{ds}T_{ds}G_{ks}A_{ks}G_k$ | 3229 |
| 1194375 | 1129544 | THA-GalNAc-$_o{}^mC_{ks}A_{ks}A_{ks}A_{ds}G_{ds}{}^mC_{ds}A_{ds}{}^mC_{ds}T_{ds}T_{ds}T_{ds}A_{ds}T_{ds}T_{ks}G_{ks}A_k$ | 3306 |
| 1194376 | 1129545 | THA-GalNAc-$_oT_{ks}{}^mC_{ks}A_{ks}A_{ds}A_{ds}G_{ds}{}^mC_{ds}A_{ds}{}^mC_{ds}T_{ds}T_{ds}T_{ds}A_{ds}T_{ks}T_{ks}G_k$ | 3382 |
| 1194377 | 1129947 | THA-GalNAc-$_oT_{ks}G_{ks}{}^mC_{ks}T_{ds}T_{ds}T_{ds}{}^mC_{ds}{}^mC_{ds}G_{ds}{}^mC_{ds}A_{ds}{}^mC_{ds}T_{ds}{}^mC_{ks}T_{ks}{}^mC_k$ | 3554 |
| 1194378 | 1130831 | THA-GalNAc-$_oG_{es}A_{eo}A_{eo}{}^mC_{eo}G_{eo}A_{ds}{}^mC_{ds}T_{ds}G_{ds}T_{ds}G_{ds}T_{ds}G_{ds}{}^mC_{ds}T_{ds}{}^mC_{eo}T_{eo}T_{es}{}^mC_{es}A_e$ | 997 |
| 1194379 | 1130868 | THA-GalNAc-$_oA_{es}{}^mC_{eo}A_{eo}T_{eo}T_{eo}T_{ds}G_{ds}T_{ds}G_{ds}G_{ds}T_{ds}A_{ds}{}^mC_{ds}A_{ds}G_{ds}{}^mC_{eo}T_{eo}G_{es}{}^mC_{es}{}^mC_e$ | 1756 |
| 1194380 | 1130871 | THA-GalNAc-$_oG_{es}G_{eo}T_{eo}A_{eo}{}^mC_{eo}A_{ds}T_{ds}T_{ds}T_{ds}G_{ds}T_{ds}G_{ds}G_{ds}T_{ds}A_{ds}{}^mC_{eo}A_{eo}G_{es}{}^mC_{es}T_e$ | 183 |
| 1194381 | 1130900 | THA-GalNAc-$_oA_{es}T_{eo}{}^mC_{eo}G_{eo}{}^mC_{eo}T_{ds}G_{ds}G_{ds}T_{ds}{}^mC_{ds}{}^mC_{ds}T_{ds}G_{ds}A_{ds}T_{ds}{}^mC_{eo}A_{eo}A_{es}A_{es}G_e$ | 1906 |
| 1194382 | 1130925 | THA-GalNAc-$_oG_{es}G_{eo}T_{eo}{}^mC_{eo}T_{eo}T_{ds}T_{ds}{}^mC_{ds}A_{ds}{}^mC_{ds}T_{ds}T_{ds}T_{ds}{}^mC_{ds}T_{ds}T_{eo}G_{eo}G_{es}G_{es}{}^mC_e$ | 1758 |
| 1194383 | 1130987 | THA-GalNAc-$_oG_{es}G_{eo}{}^mC_{eo}T_{eo}{}^mC_{eo}A_{ds}A_{ds}A_{ds}G_{ds}{}^mC_{ds}A_{ds}{}^mC_{ds}T_{ds}T_{ds}{}^mC_{ds}T_{eo}{}^mC_{eo}T_{es}T_{es}T_e$ | 2135 |
| 1194384 | 1131013 | THA-GalNAc-$_oA_{es}{}^mC_{eo}{}^mC_{eo}A_{eo}T_{eo}A_{ds}T_{ds}{}^mC_{ds}T_{ds}{}^mC_{ds}A_{ds}T_{ds}T_{ds}{}^mC_{ds}T_{ds}T_{eo}G_{eo}T_{es}G_{es}G_e$ | 1984 |
| 1194385 | 1131040 | THA-GalNAc-$_oA_{es}{}^mC_{eo}{}^mC_{eo}{}^mC_{eo}T_{eo}T_{ds}G_{ds}{}^mC_{ds}A_{ds}{}^mC_{ds}T_{ds}G_{ds}G_{ds}{}^mC_{ds}A_{ds}T_{eo}{}^mC_{eo}T_{es}G_{es}G_e$ | 1911 |
| 1194387 | 1131204 | THA-GalNAc-$_oA_{es}G_{eo}T_{eo}T_{eo}{}^mC_{eo}T_{ds}G_{ds}{}^mC_{ds}G_{ds}{}^mC_{ds}T_{ds}T_{ds}G_{ds}{}^mC_{ds}T_{ds}{}^mC_{eo}G_{eo}G_{es}{}^mC_{es}A_e$ | 1618 |
| 1194388 | 1131432 | THA-GalNAc-$_oG_{es}G_{eo}T_{eo}A_{eo}G_{eo}G_{ds}A_{ds}G_{ds}{}^mC_{ds}G_{ds}{}^mC_{ds}A_{ds}{}^mC_{ds}G_{ds}G_{ds}{}^mC_{eo}{}^mC_{eo}A_{es}A_{es}{}^mC_e$ | 1925 |
| 1194389 | 1131593 | THA-GalNAc-$_oT_{es}G_{eo}A_{eo}T_{eo}G_{eo}{}^mC_{ds}{}^mC_{ds}T_{ds}T_{ds}G_{ds}{}^mC_{ds}A_{ds}G_{ds}G_{ds}G_{ds}T_{eo}G_{eo}A_{es}G_{es}{}^mC_e$ | 1326 |
| 1194390 | 1131595 | THA-GalNAc-$_oG_{es}A_{eo}T_{eo}G_{eo}A_{eo}T_{ds}G_{ds}{}^mC_{ds}{}^mC_{ds}T_{ds}T_{ds}G_{ds}{}^mC_{ds}A_{ds}G_{ds}G_{eo}G_{eo}T_{es}G_{es}A_e$ | 1556 |
| 1194391 | 1131671 | THA-GalNAc-$_oG_{es}{}^mC_{eo}A_{eo}A_{eo}T_{eo}{}^mC_{ds}A_{ds}G_{ds}G_{ds}A_{ds}A_{ds}A_{ds}{}^mC_{ds}G_{ds}G_{ds}T_{eo}G_{eo}T_{es}G_{es}{}^mC_e$ | 950 |
| 1194392 | 1131693 | THA-GalNAc-$_oT_{es}G_{eo}{}^mC_{eo}G_{eo}G_{eo}A_{ds}A_{ds}T_{ds}{}^mC_{ds}A_{ds}{}^mC_{ds}{}^mC_{ds}A_{ds}A_{ds}G_{ds}G_{eo}A_{eo}G_{es}G_{es}G_e$ | 496 |

TABLE 118-continued

Design of GalNAc conjugated modified oligonucleotides complementary to human FXII

| Compound No. | Parent Compound No. | Sequence and Chemistry notation (5' to 3') | SEQ ID No. |
|---|---|---|---|
| 1194393 | 1131694 | THA-GalNAc-$_o{}^mC_{es}T_{eo}G_{eo}{}^mC_{eo}G_{eo}G_{ds}A_{ds}A_{ds}T_{ds}{}^mC_{ds}A_{ds}{}^mC_{ds}{}^mC_{ds}A_{ds}A_{ds}G_{eo}G_{eo}A_{es}G_{es}G_e$ | 571 |
| 1194394 | 1131697 | THA-GalNAc-$_o{}^mC_{es}T_{eo}{}^mC_{eo}A_{eo}{}^mC_{eo}T_{ds}G_{ds}{}^mC_{ds}G_{ds}G_{ds}A_{ds}A_{ds}T_{ds}{}^mC_{ds}A_{ds}{}^mC_{eo}{}^mC_{eo}A_{es}A_{es}G_e$ | 802 |
| 1194395 | 1131699 | THA-GalNAc-$_oT_{es}{}^mC_{eo}T_{eo}{}^mC_{eo}T_{eo}{}^mC_{ds}A_{ds}{}^mC_{ds}T_{ds}G_{ds}{}^mC_{ds}G_{ds}G_{ds}A_{ds}A_{ds}T_{eo}{}^mC_{eo}A_{es}{}^mC_{es}{}^mC_e$ | 951 |
| 1194396 | 1131700 | THA-GalNAc-$_o{}^mC_{es}T_{eo}{}^mC_{eo}T_{eo}{}^mC_{eo}T_{ds}{}^mC_{ds}A_{ds}{}^mC_{ds}T_{ds}G_{ds}{}^mC_{ds}G_{ds}G_{ds}A_{ds}A_{eo}T_{eo}{}^mC_{es}A_{es}{}^mC_e$ | 1028 |
| 1194397 | 1131701 | THA-GalNAc-$_oA_{es}{}^mC_{eo}T_{eo}{}^mC_{eo}T_{eo}{}^mC_{ds}T_{ds}{}^mC_{ds}A_{ds}{}^mC_{ds}T_{ds}G_{ds}{}^mC_{ds}G_{ds}G_{ds}A_{eo}A_{eo}T_{es}{}^mC_{es}A_e$ | 1179 |
| 1194398 | 1131702 | THA-GalNAc-$_o{}^mC_{es}{}^mC_{eo}A_{eo}{}^mC_{eo}T_{eo}{}^mC_{ds}T_{ds}{}^mC_{ds}T_{ds}{}^mC_{ds}A_{ds}{}^mC_{ds}T_{ds}G_{ds}{}^mC_{ds}G_{eo}G_{eo}A_{es}A_{es}T_e$ | 1103 |
| 1194399 | 1131712 | THA-GalNAc-$_o{}^mC_{es}T_{eo}T_{eo}{}^mC_{eo}{}^mC_{eo}A_{ds}T_{ds}G_{ds}{}^mC_{ds}{}^mC_{ds}{}^mC_{ds}{}^mC_{ds}A_{ds}G_{ds}{}^mC_{ds}{}^mC_{eo}A_{eo}{}^mC_{es}T_{es}{}^mC_e$ | 1935 |
| 1194400 | 1131745 | THA-GalNAc-$_oA_{es}G_{eo}T_{eo}T_{eo}{}^mC_{eo}{}^mC_{ds}T_{ds}G_{ds}{}^mC_{ds}G_{ds}{}^mC_{ds}{}^mC_{ds}A_{ds}T_{ds}{}^mC_{ds}{}^mC_{eo}T_{eo}G_{es}G_{es}{}^mC_e$ | 2309 |
| 1194401 | 1131747 | THA-GalNAc-$_oT_{es}G_{eo}A_{eo}G_{eo}T_{eo}T_{ds}{}^mC_{ds}{}^mC_{ds}T_{ds}G_{ds}{}^mC_{ds}G_{ds}{}^mC_{ds}{}^mC_{ds}A_{ds}T_{eo}{}^mC_{eo}{}^mC_{es}T_{es}G_e$ | 347 |
| 1194402 | 1131753 | THA-GalNAc-$_o{}^mC_{es}A_{eo}{}^mC_{eo}T_{eo}T_{eo}T_{ds}A_{ds}T_{ds}T_{ds}G_{ds}A_{ds}G_{ds}T_{ds}T_{ds}{}^mC_{ds}{}^mC_{eo}T_{eo}G_{es}{}^mC_{es}G_e$ | 163 |
| 1194403 | 1131754 | THA-GalNAc-$_oG_{es}{}^mC_{eo}A_{eo}{}^mC_{eo}T_{eo}T_{ds}T_{ds}A_{ds}T_{ds}T_{ds}G_{ds}A_{ds}G_{ds}T_{ds}T_{ds}{}^mC_{eo}{}^mC_{eo}T_{es}G_{es}{}^mC_e$ | 164 |
| 1194404 | 1131755 | THA-GalNAc-$_oA_{es}G_{eo}{}^mC_{eo}A_{eo}{}^mC_{eo}T_{ds}T_{ds}T_{ds}A_{ds}T_{ds}T_{ds}G_{ds}A_{ds}G_{ds}T_{ds}T_{eo}{}^mC_{eo}{}^mC_{es}T_{es}G_e$ | 953 |
| 1194405 | 1131756 | THA-GalNAc-$_oA_{es}A_{eo}G_{eo}{}^mC_{eo}A_{eo}{}^mC_{ds}T_{ds}T_{ds}T_{ds}A_{ds}T_{ds}T_{ds}G_{ds}A_{ds}G_{ds}T_{eo}T_{eo}{}^mC_{es}{}^mC_{es}T_e$ | 1030 |
| 1194406 | 1131757 | THA-GalNAc-$_oA_{es}A_{eo}A_{eo}G_{eo}{}^mC_{eo}A_{ds}{}^mC_{ds}T_{ds}T_{ds}T_{ds}A_{ds}T_{ds}T_{ds}G_{ds}A_{ds}G_{eo}T_{eo}T_{es}{}^mC_{es}{}^mC_e$ | 165 |
| 1194407 | 1131758 | THA-GalNAc-$_o{}^mC_{es}A_{eo}A_{eo}A_{eo}G_{eo}{}^mC_{ds}A_{ds}{}^mC_{ds}T_{ds}T_{ds}T_{ds}A_{ds}T_{ds}T_{ds}G_{ds}A_{eo}G_{eo}T_{es}T_{es}{}^mC_e$ | 1105 |
| 1194408 | 1131763 | THA-GalNAc-$_oG_{es}{}^mC_{eo}A_{eo}T_{eo}T_{eo}T_{ds}T_{ds}{}^mC_{ds}A_{ds}A_{ds}A_{ds}G_{ds}{}^mC_{ds}A_{ds}{}^mC_{ds}T_{eo}T_{eo}T_{es}A_{es}T_e$ | 1562 |
| 1194409 | 1131764 | THA-GalNAc-$_oA_{es}G_{eo}{}^mC_{eo}A_{eo}T_{eo}T_{ds}T_{ds}T_{ds}{}^mC_{ds}A_{ds}A_{ds}A_{ds}G_{ds}{}^mC_{ds}A_{ds}{}^mC_{eo}T_{eo}T_{es}T_{es}A_e$ | 97 |
| 1194410 | 1131891 | THA-GalNAc-$_o{}^mC_{es}{}^mC_{eo}G_{eo}A_{eo}{}^mC_{eo}T_{ds}G_{ds}T_{ds}G_{ds}T_{ds}G_{ds}{}^mC_{ds}T_{ds}{}^mC_{ds}T_{ds}T_{eo}{}^mC_{eo}A_{es}G_{es}{}^mC_e$ | 659 |
| 1194411 | 1132187 | THA-GalNAc-$_oG_{es}T_{eo}T_{eo}T_{eo}G_{eo}{}^mC_{ds}T_{ds}A_{ds}G_{ds}T_{ds}T_{ds}{}^mC_{ds}A_{ds}A_{ds}T_{ds}G_{eo}T_{eo}T_{es}{}^mC_{es}A_e$ | 1876 |
| 1194412 | 1132188 | THA-GalNAc-$_oA_{es}{}^mC_{eo}T_{eo}G_{eo}T_{eo}T_{ds}G_{ds}{}^mC_{ds}T_{ds}A_{ds}G_{ds}T_{ds}T_{ds}{}^mC_{ds}A_{eo}A_{eo}T_{es}G_{es}T_e$ | 1951 |
| 1194413 | 1132189 | THA-GalNAc-$_oA_{es}A_{eo}T_{eo}A_{eo}{}^mC_{eo}T_{ds}G_{ds}T_{ds}T_{ds}G_{ds}{}^mC_{ds}T_{ds}A_{ds}G_{ds}T_{eo}T_{eo}{}^mC_{es}A_{es}A_e$ | 2025 |
| 1194415 | 1132270 | THA-GalNAc-$_oa_{es}T_{eo}T_{eo}{}^mC_{eo}{}^mC_{eo}{}^mC_{ds}A_{ds}G_{ds}T_{ds}T_{ds}A_{ds}A_{ds}G_{ds}G_{ds}T_{o}{}^mC_{eo}A_{es}A_{es}{}^mC_e$ | 1730 |
| 1194416 | 1132271 | THA-GalNAc-$_o{}^mC_{es}A_{eo}{}^mC_{eo}A_{eo}A_{eo}T_{ds}{}^mC_{ds}{}^mC_{ds}{}^mC_{ds}A_{ds}G_{ds}T_{ds}T_{ds}A_{ds}A_{ds}G_{eo}G_{eo}T_{es}T_{es}{}^mC_e$ | 1879 |
| 1194417 | 1132272 | THA-GalNAc-$_oT_{es}T_{eo}G_{eo}{}^mC_{eo}A_{eo}{}^mC_{ds}A_{ds}T_{ds}T_{ds}{}^mC_{ds}{}^mC_{ds}{}^mC_{ds}A_{ds}G_{ds}T_{ds}T_{eo}A_{eo}A_{es}G_{es}G_e$ | 1954 |

TABLE 118-continued

Design of GalNAc conjugated modified oligonucleotides complementary to human FXII

| Compound No. | Parent Compound No. | Sequence and Chemistry notation (5' to 3') | SEQ ID No. |
|---|---|---|---|
| 1194419 | 1132504 | THA-GalNAc-$_o$G$_{es}$T$_{eo}$T$_{eo}$Te$^m$C$_{eo}$$^m$C$_{ds}$A$_{ds}$A$_{ds}$G$_{ds}$$^m$C$_{ds}$T$_{ds}$T$_{ds}$G$_{ds}$G$_{ds}$T$_{ds}$T$_{eo}$T$_{eo}$A$_{es}$$^m$C$_{es}$$^m$C$_e$ | 449 |
| 1194420 | 1132505 | THA-GalNAc-$_o$$^m$C$_{es}$A$_{eo}$A$_{eo}$G$_{eo}$T$_{eo}$T$_{ds}$T$_{ds}$$^m$C$_{ds}$$^m$C$_{ds}$A$_{ds}$A$_{ds}$G$_{ds}$$^m$C$_{ds}$T$_{ds}$T$_{ds}$G$_{eo}$G$_{eo}$T$_{es}$T$_{es}$T$_e$ | 525 |
| 1194421 | 1132506 | THA-GalNAc-$_o$$^m$C$_{es}$T$_{eo}$$^m$C$_{eo}$C$_{eo}$A$_{eo}$A$_{ds}$G$_{ds}$T$_{ds}$T$_{ds}$T$_{ds}$$^m$C$_{ds}$$^m$C$_{ds}$A$_{ds}$A$_{ds}$G$_{ds}$$^m$C$_{eo}$T$_{eo}$T$_{es}$G$_{es}$G$_e$ | 600 |
| 1194423 | 1132650 | THA-GalNAc-$_o$T$_{es}$T$_{eo}$G$_{eo}$$^m$C$_{eo}$$^m$C$_{eo}$T$_{ds}$T$_{ds}$G$_{ds}$G$_{ds}$T$_{ds}$G$_{ds}$T$_{ds}$$^m$C$_{ds}$T$_{ds}$G$_{ds}$A$_{eo}$G$_{eo}$G$_{es}$A$_{es}$G$_e$ | 910 |
| 1194424 | 1132651 | THA-GalNAc-$_o$A$_{es}$G$_{eo}$$^m$C$_{eo}$T$_{eo}$T$_{eo}$G$_{ds}$$^m$C$_{ds}$$^m$C$_{ds}$T$_{ds}$T$_{ds}$G$_{ds}$G$_{ds}$T$_{ds}$G$_{ds}$T$_{ds}$$^m$C$_{eo}$T$_{eo}$G$_{es}$A$_{es}$G$_e$ | 985 |
| 1194425 | 1132652 | THA-GalNAc-$_o$A$_{es}$G$_{eo}$$^m$C$_{eo}$A$_{eo}$G$_{eo}$$^m$C$_{ds}$T$_{ds}$T$_{ds}$G$_{ds}$$^m$C$_{ds}$$^m$C$_{ds}$T$_{ds}$T$_{ds}$G$_{ds}$G$_{ds}$T$_{eo}$G$_{eo}$T$_{es}$$^m$C$_{es}$T$_e$ | 1062 |
| 1194426 | 1132796 | THA-GalNAc-$_o$G$_{es}$A$_{eo}$A$_{eo}$$^m$C$_{eo}$$^m$C$_{eo}$A$_{ds}$A$_{ds}$G$_{ds}$A$_{ds}$G$_{ds}$$^m$C$_{ds}$A$_{ds}$A$_{ds}$G$_{ds}$T$_{ds}$T$_{eo}$$^m$C$_{eo}$G$_{es}$A$_{es}$T$_e$ | 1523 |
| 1194427 | 1132797 | THA-GalNAc-$_o$A$_{es}$G$_{eo}$G$_{eo}$G$_{eo}$A$_{eods}$$^m$C$_{ds}$$^m$C$_{ds}$A$_{ds}$A$_{ds}$G$_{ds}$A$_{ds}$G$_{ds}$$^m$C$_{ds}$A$_{ds}$A$_{eo}$G$_{eo}$T$_{es}$T$_{es}$$^m$C$_e$ | 1369 |
| 1194429 | 1194286 | THA-GalNAc-$_o$$^m$C$_{ks}$T$_{ks}$T$_{ks}$T$_{ds}$$^m$C$_{ds}$$^m$C$_{ds}$G$_{ds}$$^m$C$_{ds}$A$_{ds}$$^m$C$_{ds}$T$_{ds}$$^m$C$_{ds}$T$_{ds}$$^m$C$_{ks}$$^m$C$_{ks}$$^m$C$_k$ | 4026 |
| 1194430 | 1194287 | THA-GalNAc-$_o$G$_{ks}$$^m$C$_{ks}$T$_{ks}$T$_{ds}$T$_{ds}$$^m$Cd$^m$C$_{ds}$G$_{ds}$$^m$C$_{ds}$A$_{ds}$$^m$C$_{ds}$T$_{ds}$$^m$C$_{ds}$T$_{ks}$$^m$C$_{ks}$$^m$C$_k$ | 4102 |
| 1194483 | 1129948 | A$_{ks}$T$_{ks}$$^m$C$_{ks}$T$_{ds}$G$_{ds}$$^m$C$_{ds}$T$_{ds}$T$_{ds}$T$_{ds}$$^m$C$_{ds}$$^m$C$_{ds}$G$_{ds}$$^m$C$_{ds}$A$_{ks}$$^m$C$_{ks}$T$_k$-3'-HPPO-GalNAc | 3630 |
| 1194484 | 1129949 | T$_{ks}$$^m$C$_{ks}$T$_{ks}$$^m$C$_{ds}$A$_{ds}$T$_{ds}$$^m$C$_{ds}$T$_{ds}$G$_{ds}$$^m$C$_{ds}$T$_{ds}$T$_{ds}$T$_{ds}$$^m$C$_{ks}$$^m$C$_{ks}$G$_k$-3'-HPPO-GalNAc | 3706 |
| 1194486 | 1128769 | A$_{ks}$G$_{ks}$A$_{ks}$A$_{ds}$$^m$C$_{ds}$G$_{ds}$A$_{ds}$$^m$C$_{ds}$T$_{ds}$G$_{ds}$T$_{ds}$G$_{ds}$T$_{ds}$G$_{ks}$$^m$C$_{ks}$T$_k$-3'-HPPO-GalNAc | 3723 |
| 1194487 | 1128796 | T$_{ks}$G$_{ks}$T$_{ks}$G$_{ds}$G$_{ds}$T$_{ds}$A$_{ds}$$^m$C$_{ds}$A$_{ds}$G$_{ds}$$^m$C$_{ds}$T$_{ds}$G$_{ds}$$^m$C$_{ks}$$^m$C$_{ks}$G$_k$-3'-HPPO-GalNAc | 2734 |
| 1194488 | 1128801 | A$_{ks}$$^m$C$_{ks}$A$_{ks}$T$_{ds}$T$_{ds}$T$_{ds}$G$_{ds}$T$_{ds}$G$_{ds}$G$_{ds}$T$_{ds}$A$_{ds}$$^m$C$_{ds}$A$_{ks}$G$_{ks}$$^m$C$_k$-3'-HPPO-GalNAc | 3114 |
| 1194489 | 1128802 | T$_{ks}$A$_{ks}$$^m$C$_{ks}$A$_{ds}$T$_{ds}$T$_{ds}$T$_{ds}$G$_{ds}$T$_{ds}$G$_{ds}$G$_{ds}$T$_{ds}$A$_{ds}$$^m$C$_{ks}$A$_{ks}$G$_k$-3'-HPPO-GalNAc | 2426 |
| 1194490 | 1128870 | T$_{ks}$G$_{ks}$T$_{ks}$G$_{ds}$G$_{ds}$A$_{ds}$A$_{ds}$A$_{ds}$A$_{ds}$A$_{ds}$$^m$C$_{ds}$$^m$C$_{ds}$G$_{ds}$G$_{ks}$A$_{ks}$G$_k$-3'-HPPO-GalNAc | 3728 |
| 1194491 | 1129221 | $^m$C$_{ks}$G$_{ks}$T$_{ks}$$^m$C$_{ds}$T$_{ds}$G$_{ds}$G$_{ds}$$^m$C$_{ds}$A$_{ds}$$^m$C$_{ds}$G$_{ds}$G$_{ds}$$^m$C$_{ds}$T$_{ks}$$^m$C$_{ks}$A$_k$-3'-HPPO-GalNAc | 3060 |
| 1194492 | 1129287 | $^m$C$_{ks}$G$_{ks}$T$_{ks}$A$_{ds}$A$_{ds}$G$_{ds}$G$_{ds}$$^m$C$_{ds}$G$_{ds}$A$_{ds}$$^m$C$_{ds}$A$_{ds}$G$_{ds}$G$_{ks}$A$_{ks}$G$_k$-3'-HPPO-GalNAc | 3521 |
| 1194493 | 1129407 | T$_{ks}$G$_{ks}$$^m$C$_{ks}$$^m$C$_{ds}$T$_{ds}$T$_{ds}$G$_{ds}$$^m$C$_{ds}$A$_{ds}$G$_{ds}$G$_{ds}$T$_{ds}$G$_{ks}$A$_{ks}$G$_k$-3'-HPPO-GalNAc | 3527 |
| 1194494 | 1129408 | A$_{ks}$T$_{ks}$G$_{ks}$A$_{ds}$T$_{ds}$G$_{ds}$$^m$C$_{ds}$$^m$C$_{ds}$T$_{ds}$T$_{ds}$G$_{ds}$$^m$C$_{ds}$A$_{ds}$G$_{ks}$G$_{ks}$G$_k$-3'-HPPO-GalNAc | 3603 |
| 1194495 | 1129409 | $^m$C$_{ks}$T$_{ks}$G$_{ks}$A$_{ds}$T$_{ds}$G$_{ds}$A$_{ds}$T$_{ds}$G$_{ds}$$^m$C$_{ds}$$^m$C$_{ds}$T$_{ds}$T$_{ds}$G$_{ks}$$^m$C$_{ks}$A$_k$-3'-HPPO-GalNAc | 3679 |
| 1194496 | 1129441 | A$_{ks}$G$_{ks}$T$_{ks}$A$_{ds}$G$_{ds}$G$_{ds}$$^m$C$_{ds}$$^m$C$_{ds}$A$_{ds}$$^m$C$_{ds}$A$_{ds}$T$_{ds}$$^m$C$_{ds}$G$_{ks}$G$_{ks}$T$_k$-3'-HPPO-GalNAc | 3071 |
| 1194497 | 1129472 | T$_{ks}$G$_{ks}$A$_{ks}$G$_{ds}$T$_{ds}$$^m$C$_{ds}$$^m$C$_{ds}$$^m$C$_{ds}$T$_{ds}$G$_{ds}$A$_{ds}$G$_{ds}$$^m$C$_{ds}$A$_{ks}$A$_{ks}$T$_k$-3'-HPPO-GalNAc | 3910 |
| 1194498 | 1129476 | A$_{ks}$A$_{ks}$G$_{ks}$A$_{ds}$T$_{ds}$G$_{ds}$A$_{ds}$G$_{ds}$T$_{ds}$$^m$C$_{ds}$$^m$C$_{ds}$$^m$C$_{ds}$T$_{ds}$G$_{ks}$A$_{ks}$G$_k$-3'-HPPO-GalNAc | 2691 |
| 1194499 | 1129483 | G$_{ks}$G$_{ks}$A$_{ks}$A$_{ds}$T$_{ds}$$^m$C$_{ds}$A$_{ds}$$^m$C$_{ds}$$^m$C$_{ds}$A$_{ds}$A$_{ds}$G$_{ds}$A$_{ds}$G$_{ks}$G$_{ks}$G$_k$-3'-HPPO-GalNAc | 3226 |
| 1194500 | 1129485 | G$_{ks}$$^m$C$_{ks}$G$_{ks}$G$_{ds}$A$_{ds}$A$_{ds}$T$_{ds}$$^m$C$_{ds}$A$_{ds}$$^m$C$_{ds}$$^m$C$_{ds}$A$_{ds}$A$_{ds}$G$_{ks}$G$_{ks}$A$_k$-3'-HPPO-GalNAc | 3379 |
| 1194501 | 1129486 | T$_{ks}$G$_{ks}$$^m$C$_{ks}$G$_{ds}$G$_{ds}$A$_{ds}$A$_{ds}$T$_{ds}$$^m$C$_{ds}$A$_{ds}$$^m$C$_{ds}$$^m$C$_{ds}$A$_{ds}$A$_{ks}$G$_{ks}$G$_k$-3'-HPPO-GalNAc | 3455 |
| 1194502 | 1129487 | $^m$C$_{ks}$T$_{ks}$G$_{ks}$$^m$C$_{ds}$G$_{ds}$G$_{ds}$A$_{ds}$A$_{ds}$T$_{ds}$$^m$C$_{ds}$A$_{ds}$$^m$C$_{ds}$$^m$C$_{ds}$A$_{ks}$A$_{ks}$G$_k$-3'-HPPO-GalNAc | 3531 |
| 1194503 | 1129488 | A$_{ks}$$^m$C$_{ks}$T$_{ks}$G$_{ds}$$^m$C$_{ds}$G$_{ds}$G$_{ds}$A$_{ds}$A$_{ds}$T$_{ds}$$^m$C$_{ds}$A$_{ds}$$^m$C$_{ds}$$^m$C$_{ks}$A$_{ks}$A$_k$-3'-HPPO-GalNAc | 3607 |
| 1194504 | 1129489 | $^m$C$_{ks}$A$_{ks}$$^m$C$_{ks}$T$_{ds}$G$_{ds}$$^m$C$_{ds}$G$_{ds}$G$_{ds}$A$_{ds}$A$_{ds}$T$_{ds}$$^m$C$_{ds}$A$_{ds}$$^m$C$_{ks}$$^m$C$_{ks}$A$_k$-3'-HPPO-GalNAc | 3683 |
| 1194505 | 1129491 | $^m$C$_{ks}$T$_{ks}$$^m$CsA$_{ds}$$^m$C$_{ds}$T$_{ds}$G$_{ds}$$^m$C$_{ds}$G$_{ds}$G$_{ds}$A$_{ds}$A$_{ds}$T$_{ds}$$^m$C$_{ks}$A$_{ks}$$^m$C$_k$-3'-HPPO-GalNAc | 3835 |
| 1194506 | 1129492 | T$_{ks}$$^m$C$_{ks}$T$_{ks}$$^m$C$_{ds}$A$_{ds}$$^m$C$_{ds}$T$_{ds}$G$_{ds}$$^m$C$_{ds}$G$_{ds}$G$_{ds}$A$_{ds}$A$_{ds}$T$_{ks}$$^m$C$_{ks}$A$_k$-3'-HPPO-GalNAc | 3911 |

TABLE 118-continued

Design of GalNAc conjugated modified oligonucleotides complementary to human FXII

| Compound No. | Parent Compound No. | Sequence and Chemistry notation (5' to 3') | SEQ ID No. |
|---|---|---|---|
| 1194507 | 1129510 | $A_{ks}G_{ks}{}^mC_{ks}T_{ds}G_{ds}G_{ds}{}^mC_{ds}{}^mC_{ds}G_{ds}{}^mC_{ds}A_{ds}{}^mC_{ds}T_{ds}G_{ks}G_{ks}G_{k}$-3'-HPPO-GalNAc | 3760 |
| 1194508 | 1129527 | $T_{ks}{}^mC_{ks}{}^mC_{ks}T_{ds}G_{ds}{}^mC_{ds}G_{ds}{}^mC_{ds}{}^mC_{ds}A_{ds}T_{ds}{}^mC_{ds}{}^mC_{ds}T_{ks}G_{ks}G_{k}$-3'-HPPO-GalNAc | 3533 |
| 1194509 | 1129530 | $A_{ks}G_{ks}T_{ks}T_{ds}{}^mC_{ds}{}^mC_{ds}T_{ds}G_{ds}{}^mC_{ds}G_{ds}{}^mC_{ds}{}^mC_{ds}A_{ds}T_{ks}{}^mC_{ks}{}^mC_{k}$-3'-HPPO-GalNAc | 3761 |
| 1194510 | 1129531 | $G_{ks}A_{ks}G_{ks}T_{ds}T_{ds}{}^mC_{ds}{}^mC_{ds}T_{ds}G_{ds}{}^mC_{ds}G_{ds}{}^mC_{ds}{}^mC_{ds}A_{ks}T_{ks}{}^mC_{k}$-3'-HPPO-GalNAc | 3837 |
| 1194512 | 1129533 | $T_{ks}T_{ks}G_{ks}A_{ds}G_{ds}T_{ds}T_{ds}{}^mC_{ds}{}^mC_{ds}T_{ds}G_{ds}{}^mC_{ds}G_{ds}{}^mC_{ks}{}^mC_{ks}A_{k}$-3'-HPPO-GalNAc | 2463 |
| 1194513 | 1129534 | $A_{ks}T_{ks}T_{ks}G_{ds}A_{ds}G_{ds}T_{ds}T_{ds}{}^mC_{ds}{}^mC_{ds}T_{ds}G_{ds}{}^mC_{ds}G_{ks}{}^mC_{ks}{}^mC_{k}$-3'-HPPO-GalNAc | 2540 |
| 1194514 | 1129538 | $A_{ks}{}^mC_{ks}T_{ks}T_{ds}T_{ds}A_{ds}T_{ds}T_{ds}G_{ds}A_{ds}G_{ds}T_{ds}T_{ds}{}^mG_{ks}{}^mC_{ks}T_{k}$-3'-HPPO-GalNAc | 2848 |
| 1194515 | 1129540 | $G_{ks}{}^mC_{ks}A_{ks}{}^mC_{ds}T_{ds}T_{ds}T_{ds}A_{ds}T_{ds}T_{ds}G_{ds}A_{ds}G_{ds}T_{ks}T_{ks}{}^mC_{k}$-3'-HPPO-GalNAc | 3000 |
| 1194516 | 1129542 | $A_{ks}A_{ks}G_{ks}{}^mC_{ds}A_{ds}{}^mC_{ds}T_{ds}T_{ds}T_{ds}A_{ds}T_{ds}T_{ds}G_{ds}A_{ks}G_{ks}T_{k}$-3'-HPPO-GalNAc | 3147 |
| 1194517 | 1129543 | $A_{ks}A_{ks}A_{ks}G_{ds}{}^mC_{ds}A_{ds}{}^mC_{ds}T_{ds}T_{ds}T_{ds}A_{ds}T_{ds}T_{ds}G_{ks}A_{ks}G_{k}$-3'-HPPO-GalNAc | 3229 |
| 1194518 | 1129544 | ${}^mC_{ks}A_{ks}A_{ks}A_{ds}G_{ds}{}^mC_{ds}A_{ds}{}^mC_{ds}T_{ds}T_{ds}T_{ds}A_{ds}T_{ds}T_{ks}G_{ks}A_{k}$-3'-HPPO-GalNAc | 3306 |
| 1194519 | 1129545 | $T_{ks}{}^mC_{ks}A_{ks}A_{ds}A_{ds}G_{ds}{}^mC_{ds}A_{ds}{}^mC_{ds}T_{ds}T_{ds}T_{ds}A_{ds}T_{ks}T_{ks}G_{k}$-3'-HPPO-GalNAc | 3382 |
| 1194520 | 1129947 | $T_{ks}G_{ks}{}^mC_{ks}T_{ds}T_{ds}T_{ds}T_{ds}{}^mC_{ds}{}^mC_{ds}G_{ds}{}^mC_{ds}A_{ds}{}^mC_{ds}T_{ks}{}^mC_{ks}{}^mC_{k}$-3'-HPPO-GalNAc | 3554 |
| 1194572 | 1194286 | ${}^mC_{ks}T_{ks}T_{ks}T_{ds}{}^mC_{ds}{}^mC_{ds}G_{ds}{}^mC_{ds}A_{ds}{}^mC_{ds}T_{ds}{}^mC_{ds}T_{ds}{}^mC_{ks}{}^mC_{ks}{}^mC_{k}$-3'-HPPO-GalNAc | 4026 |
| 1194573 | 1194287 | $G_{ks}{}^mC_{ks}T_{ks}T_{ds}T_{ds}{}^mC_{ds}{}^mC_{ds}G_{ds}{}^mC_{ds}A_{ds}{}^mC_{ds}T_{ds}{}^mC_{ds}T_{ks}{}^mC_{ks}{}^mC_{k}$-3'-HPPO-GalNAc | 4102 |
| 1194574 | 1194288 | ${}^mC_{ks}T_{ks}G_{ks}{}^mC_{ds}T_{ds}T_{ds}T_{ds}{}^mC_{ds}{}^mC_{ds}G_{ds}{}^mC_{ds}A_{ds}{}^mC_{ds}T_{ks}{}^mC_{ks}T_{k}$-3'-HPPO-GalNAc | 4253 |
| 1194575 | 1194289 | $T_{ks}{}^mC_{ks}T_{ks}G_{ds}{}^mC_{ds}T_{ds}T_{ds}T_{ds}{}^mC_{ds}{}^mC_{ds}G_{ds}{}^mC_{ds}A_{ds}{}^mC_{ks}T_{ks}{}^mC_{k}$-3'-HPPO-GalNAc | 4329 |
| 1194576 | 1194290 | ${}^mC_{ks}A_{ks}T_{ks}{}^mC_{ds}T_{ds}G_{ds}{}^mC_{ds}T_{ds}T_{ds}T_{ds}{}^mC_{ds}{}^mC_{ds}G_{ds}{}^mC_{ks}A_{ks}{}^mC_{k}$-3'-HPPO-GalNAc | 4405 |
| 1194578 | 1194292 | ${}^mC_{ks}T_{ks}{}^mC_{ks}A_{ds}T_{ds}{}^mC_{ds}T_{ds}G_{ds}{}^mC_{ds}T_{ds}T_{ds}T_{ds}{}^mC_{ds}{}^mC_{ks}G_{ks}{}^mC_{k}$-3'-HPPO-GalNAc | 4557 |
| 1194579 | 1194293 | ${}^mC_{ks}T_{ks}{}^mC_{ks}T_{ds}{}^mC_{ds}A_{ds}T_{ds}{}^mC_{ds}T_{ds}G_{ds}{}^mC_{ds}T_{ds}T_{ks}{}^mC_{ks}{}^mC_{k}$-3'-HPPO-GalNAc | 4708 |
| 1194580 | 1194294 | ${}^mC_{ks}{}^mC_{ks}T_{ks}{}^mC_{ds}T_{ds}{}^mC_{ds}A_{ds}T_{ds}{}^mC_{ds}T_{ds}G_{ds}{}^mC_{ds}T_{ds}T_{ks}T_{ks}{}^mC_{k}$-3'-HPPO-GalNAc | 4783 |
| 1194581 | 1194295 | ${}^mC_{ks}{}^mC_{ks}{}^mC_{ks}T_{ds}{}^mC_{ds}T_{ds}{}^mC_{ds}A_{ds}T_{ds}{}^mC_{ds}T_{ds}G_{ds}{}^mC_{ds}T_{ks}T_{ks}T_{k}$-3'-HPPO-GalNAc | 4859 |
| 1194582 | 1194296 | $T_{ks}{}^mC_{ks}{}^mC_{ks}{}^mC_{ds}T_{ds}{}^mC_{ds}T_{ds}{}^mC_{ds}A_{ds}T_{ds}{}^mC_{ds}T_{ds}G_{ds}{}^mC_{ks}T_{ks}T_{k}$-3'-HPPO-GalNAc | 3950 |
| 1194583 | 1194297 | ${}^mC_{ks}T_{ks}{}^mC_{ks}{}^mC_{ds}{}^mC_{ds}T_{ds}{}^mC_{ds}T_{ds}{}^mC_{ds}A_{ds}T_{ds}{}^mC_{ds}T_{ds}G_{ks}{}^mC_{ks}T_{k}$-3'-HPPO-GalNAc | 4027 |
| 1270699 | 1207006 | THA-GalNAc-${}_o{}^mC_kA_{es}{}^mC_{ks}T_{ds}T_{ds}T_{ds}A_{ds}T_{ds}T_{ds}G_{ds}A_{ds}G_{ds}T_{es}T_{es}{}^mC_{ks}{}^mC_{k}$ | 2924 |
| 1270700 | 1207007 | THA-GalNAc-${}_oG_{ks}{}^mC_{es}A_{ks}{}^mC_{ds}T_{ds}T_{ds}T_{ds}A_{ds}T_{ds}T_{ds}G_{ds}A_{ds}G_{es}T_{es}T_{ks}{}^mC_{k}$ | 3000 |
| 1270701 | 1207160 | THA-GalNAc-${}_o{}^mC_{ks}A_{ks}{}^mC_{ds}T_{ds}T_{ds}T_{ds}A_{ds}T_{ds}T_{ds}G_{ds}A_{ds}G_{es}T_{es}T_{es}{}^mC_{ks}{}^mC_{k}$ | 2924 |
| 1270702 | 1207161 | THA-GalNAc-${}_oG_{ks}{}^mC_{ks}A_{ds}{}^mC_{ds}T_{ds}T_{ds}T_{ds}A_{ds}T_{ds}T_{ds}G_{ds}A_{es}G_{es}T_{es}T_{ks}{}^mC_{k}$ | 3000 |
| 1270703 | 1207277 | THA-GalNAc-${}_o{}^mC_{ks}A_{ks}{}^mC_{ds}T_{ds}T_{ds}T_{ds}A_{ds}T_{ds}T_{ds}G_{ds}A_{ds}G_{es}T_{ks}T_{es}{}^mC_{ks}{}^mC_{e}$ | 2924 |
| 1270705 | 1213144 | THA-GalNAc-${}_oG_{ks}{}^mC_{ks}A_{ks}{}^mC_{ds}UyT_{ds}T_{ds}A_{ds}T_{ds}T_{ds}G_{ds}A_{ds}G_{ds}T_{ks}T_{ks}{}^mC_{k}$ | 5006 |
| 1270707 | 1213260 | THA-GalNAc-${}_o{}^mC_{ks}A_{ks}{}^mC_{ks}T_{ds}T_{ds}UysA_{ds}T_{ds}T_{ds}G_{ds}A_{ds}G_{ds}T_{ds}T_{ks}{}^mC_{ks}{}^mC_{k}$ | 5035 |
| 1270710 | 1207393 | THA-GalNAc-${}_oA_{ks}{}^mC_{ks}T_{ds}T_{ds}T_{ds}A_{ds}T_{ds}T_{ds}G_{ds}A_{ds}G_{ds}T_{ks}T_{es}{}^mC_{ks}{}^mC_{es}T_{k}$ | 2848 |
| 1270712 | 1207394 | THA-GalNAc-${}_o{}^mC_{ks}A_{ks}{}^mC_{ds}T_{ds}T_{ds}T_{ds}A_{ds}T_{ds}T_{ds}G_{ds}A_{ds}G_{ks}T_{es}T_{ks}{}^mC_{es}{}^mC_{k}$ | 2924 |
| 1270714 | 1207279 | THA-GalNAc-${}_oA_{ks}G_{ks}{}^mC_{ds}A_{ds}{}^mC_{ds}T_{ds}T_{ds}T_{ds}A_{ds}T_{ds}T_{ds}G_{es}A_{ks}G_{es}T_{ks}Te$ | 3076 |
| 1270715 | 1207159 | THA-GalNAc-${}_oA_{ks}{}^mC_{ks}T_{ds}T_{ds}T_{ds}A_{ds}T_{ds}T_{ds}G_{ds}A_{ds}G_{ds}T_{es}T_{es}{}^mC_{es}{}^mC_{ks}T_{k}$ | 2848 |
| 1270716 | 1207005 | THA-GalNAc-${}_oA_{ks}{}^mC_{es}T_{ks}T_{ds}T_{ds}A_{ds}T_{ds}T_{ds}G_{ds}A_{ds}G_{ds}T_{ds}T_{es}{}^mC_{es}{}^mC_{ks}T_{k}$ | 2848 |

Example 9: Design of Oligomeric Compounds Complementary to a Human FXII Nucleic Acid Modified oligonucleotides were designed as indicated in the tables below. The chemistry notation column in the tables below specifies the specific chemistry notation for modified oligonucleotides; wherein subscript 'd' represents a 2'-β-D-deoxyribosyl sugar moiety, subscript 'e' represents a 2'-MOE sugar moiety, subscript 'y' represents a 2'-O-methyl sugar moiety, subscript 'k' represents a cET modified sugar moiety, subscript 's' represents a phosphorothioate internucleoside linkage, subscript 'o' represents a phosphodiester internucleoside linkage, and superscript 'm' before the cytosine residue ($^m$C) represents a 5-methyl cytosine.

"Start site" indicates the 5'-most nucleoside of the target sequence to which the modified oligonucleotide is complementary. "Stop site" indicates the 3'-most nucleoside of the target sequence to which the modified oligonucleotide is complementary. As shown in the tables below, the modified oligonucleotides are complementary to either the human FXII mRNA, designated herein as SEQ ID NO: 1 (described herein above) or to the human FXII genomic sequence, designated herein as SEQ ID NO: 2 (described herein above) or to both. 'N/A' indicates that the modified oligonucleotide is not complementary to that particular target sequence with 100% complementarity.

TABLE 119

5-10-5 2'O-methyl modified oligonucleotides complementary to human FXII

| Compound Number | SEQ ID NO: 1 Start Site | SEQ ID NO: 1 Stop Site | SEQ ID NO: 2 Start Site | SEQ ID NO: 2 Stop Site | Sequence and Chemistry notation (5' to 3') | SEQ ID No. |
|---|---|---|---|---|---|---|
| 1213034 | 2014 | 2033 | 7402 | 7421 | $C_{ys}A_{ys}C_{ys}U_{ys}U_{ys}T_{ds}A_{ds}T_{ds}T_{ds}G_{ds}A_{ds}G_{ds}T_{ds}T_{ds}{}^mC_{ds}C_{ys}U_{ys}G_{ys}C_{ys}G_y$ | 5039 |
| 1358035 | 1936 | 1955 | 7324 | 7343 | $C_{ys}C_{ys}C_{ys}C_{ys}A_{ys}G_{ds}{}^mC_{ds}{}^mC_{ds}A_{ds}{}^mC_{ds}T_{ds}{}^mC_{ds}T_{ds}{}^mC_{ds}T_{ds}C_{ys}A_{ys}C_{ys}U_{ys}G_y$ | 5040 |
| 1213030 | 1924 | 1943 | 7312 | 7331 | $U_{ys}C_{ys}U_{ys}C_{ys}A_{ys}{}^mC_{ds}T_{ds}G_{ds}{}^mC_{ds}G_{ds}G_{ds}A_{ds}A_{ds}T_{ds}{}^mC_{ds}A_{ys}C_{ys}C_{ys}A_{ys}A_y$ | 5041 |
| 1213029 | 1914 | 1933 | 7302 | 7321 | $G_{ys}A_{ys}A_{ys}U_{ys}C_{ys}A_{ds}{}^mC_{ds}{}^mC_{ds}A_{ds}A_{ds}G_{ds}G_{ds}A_{ds}G_{ds}G_{ys}A_{ys}A_{ys}A_{ys}G_y$ | 5042 |

Example 10: Tolerability of Modified Oligonucleotides Targeting Human FXII in CD-1 Mice CD-1 mice are a multipurpose mouse model frequently utilized for safety and efficacy testing. The mice were treated with modified oligonucleotides selected from studies described above and evaluated for changes in the levels of various plasma chemistry markers.

Study 1

Groups of four 7-to-8-week-old male CD-1 mice were injected subcutaneously once a week for six weeks (for a total of 6 treatments) with 80 mg/kg of modified oligonucleotides. One group of four male CD-1 mice was injected with saline. Mice were euthanized 72 hours following the final administration.

To evaluate the effect of modified oligonucleotides on liver and kidney function, plasma levels of aspartate aminotransferase (AST), alanine aminotransferase (ALT), total bilirubin (TBIL), blood urea nitrogen (BUN), creatinine (CRT) and albumin were measured using an automated clinical chemistry analyzer (Hitachi Olympus AU400c, Melville, NY). The results are presented in the table below. Modified oligonucleotides that caused changes in the levels of any of the liver or kidney function markers outside the expected range for modified oligonucleotides were excluded in further studies.

TABLE 120

Plasma chemistry markers in male CD-1 mice

| Compound No. | AST (IU/L) | ALT (IU/L) | TBIL (mg/dL) | BUN (mg/dL) | CRT (mg/dL) | Albumin (mg/dL) |
|---|---|---|---|---|---|---|
| saline | 51 | 33 | 0.27 | 25 | 0.05 | 2.82 |
| 1194378 | 603 | 1124 | 0.34 | 27 | 0.07 | 2.61 |
| 1194379 | 255 | 740 | 0.25 | 22 | 0.04 | 2.65 |
| 1194380 | 62 | 58 | 0.17 | 26 | 0.08 | 2.84 |
| 1194381 | 368 | 375 | 0.18 | 24 | 0.09 | 2.83 |
| 1194382 | 380 | 423 | 0.21 | 25 | 0.08 | 2.67 |
| 1194383 | 72 | 104 | 0.15 | 25 | 0.06 | 2.54 |
| 1194384 | 66 | 41 | 0.17 | 23 | 0.05 | 2.70 |
| 1194385 | 1287 | 1501 | 0.24 | 27 | 0.08 | 2.10 |
| 1194387 | 157 | 239 | 0.26 | 27 | 0.06 | 2.69 |
| 1194388 | 68 | 48 | 0.17 | 24 | 0.07 | 2.77 |
| 1194389 | 69 | 53 | 0.16 | 25 | 0.06 | 2.75 |
| 1194390 | 870 | 1395 | 0.22 | 26 | 0.08 | 2.84 |
| 1194391 | 49 | 40 | 0.17 | 23 | 0.07 | 2.81 |
| 1194392 | 62 | 56 | 0.16 | 27 | 0.07 | 2.75 |

TABLE 120-continued

Plasma chemistry markers in male CD-1 mice

| Compound No. | AST (IU/L) | ALT (IU/L) | TBIL (mg/dL) | BUN (mg/dL) | CRT (mg/dL) | Albumin (mg/dL) |
|---|---|---|---|---|---|---|
| 1194393 | 51 | 39 | 0.16 | 22 | 0.07 | 2.58 |
| 1194394 | 99 | 106 | 0.20 | 24 | 0.07 | 2.84 |
| 1194395 | 71 | 112 | 0.13 | 24 | 0.05 | 2.53 |
| 1194396 | 1614 | 1954 | 1.81 | 18 | 0.03 | 2.54 |
| 1194397 | 678 | 836 | 0.20 | 17 | 0.06 | 2.62 |
| 1194398 | 713 | 867 | 0.20 | 23 | 0.07 | 2.76 |
| 1194399 | 548 | 393 | 0.26 | 26 | 0.07 | 2.84 |
| 1194400 | 854 | 1165 | 0.66 | 22 | 0.07 | 2.78 |
| 1194401 | 457 | 1201 | 0.23 | 27 | 0.05 | 2.76 |

Body weights of CD-1 mice were measured at days 1 and 40, and the average body weight for each group is presented in the table below. Liver, kidney and spleen weights were measured at the end of the study and are presented in the table below. Modified oligonucleotides that caused any changes in organ weights outside the expected range for modified oligonucleotides were excluded from further studies.

TABLE 121

Body and organ weights (in grams)

| Compound No. | Body Weight (g) Day 1 | Body Weight (g) Day 40 | Liver (g) | Kidney (g) | Spleen (g) |
|---|---|---|---|---|---|
| saline | 31 | 36 | 2.0 | 0.6 | 0.1 |
| 1194378 | 32 | 39 | 2.6 | 0.6 | 0.1 |
| 1194379 | 32 | 38 | 2.7 | 0.6 | 0.1 |
| 1194380 | 32 | 38 | 2.6 | 0.6 | 0.1 |
| 1194381 | 32 | 40 | 2.8 | 0.6 | 0.1 |
| 1194382 | 32 | 38 | 2.5 | 0.6 | 0.1 |
| 1194383 | 31 | 36 | 2.2 | 0.5 | 0.1 |
| 1194384 | 32 | 40 | 2.2 | 0.6 | 0.1 |
| 1194385 | 31 | 39 | 3.0 | 0.6 | 0.1 |
| 1194387 | 30 | 37 | 2.2 | 0.5 | 0.3 |
| 1194388 | 31 | 38 | 2.5 | 0.6 | 0.2 |
| 1194389 | 30 | 37 | 2.3 | 0.6 | 0.1 |
| 1194390 | 32 | 38 | 3.2 | 0.6 | 0.1 |
| 1194391 | 30 | 37 | 2.4 | 0.6 | 0.1 |
| 1194392 | 32 | 38 | 2.2 | 0.6 | 0.1 |
| 1194393 | 31 | 38 | 2.0 | 0.6 | 0.1 |
| 1194394 | 31 | 37 | 2.1 | 0.6 | 0.1 |
| 1194395 | 32 | 37 | 2.4 | 0.6 | 0.1 |
| 1194396 | 31 | 35 | 2.0 | 0.6 | 0.1 |
| 1194397 | 32 | 40 | 2.8 | 0.6 | 0.1 |
| 1194398 | 32 | 38 | 3.0 | 0.6 | 0.2 |
| 1194399 | 32 | 38 | 2.9 | 0.6 | 0.2 |
| 1194400 | 31 | 38 | 3.2 | 0.6 | 0.1 |
| 1194401 | 33 | 41 | 2.6 | 0.6 | 0.2 |

Study 2

Groups of four 7-to-8-week-old male CD-1 mice were injected subcutaneously once a week for six weeks (for a total of 6 treatments) with 80 mg/kg of modified oligonucleotides. One group of four male CD-1 mice was injected with saline. Mice were euthanized 72 hours following the final administration.

To evaluate the effect of modified oligonucleotides on liver and kidney function, plasma levels of aspartate aminotransferase (AST), alanine aminotransferase (ALT), total bilirubin (TBIL), blood urea nitrogen (BUN), creatinine (CRT) and albumin were measured using an automated clinical chemistry analyzer (Hitachi Olympus AU400c, Melville, NY). The results are presented in the table below. Modified oligonucleotides that caused changes in the levels of any of the liver or kidney function markers outside the expected range for modified oligonucleotides were excluded in further studies.

TABLE 122

Plasma chemistry markers in male CD-1 mice

| Compound No. | AST (IU/L) | ALT (IU/L) | TBIL (mg/dL) | BUN (mg/dL) | CRT (mg/dL) | Albumin (mg/dL) |
|---|---|---|---|---|---|---|
| saline | 70 | 68 | 0.16 | 22 | 0.09 | 2.84 |
| 1194402 | 66 | 66 | 0.17 | 24 | 0.09 | 2.73 |
| 1194403 | 67 | 64 | 0.15 | 26 | 0.09 | 2.64 |
| 1194404 | 77 | 82 | 0.17 | 25 | 0.10 | 2.91 |
| 1194405 | 100 | 155 | 0.14 | 25 | 0.07 | 2.53 |
| 1194406 | 95 | 84 | 0.15 | 25 | 0.07 | 2.60 |
| 1194407 | 94 | 69 | 0.11 | 19 | 0.07 | 2.56 |
| 1194408 | 111 | 137 | 0.15 | 26 | 0.06 | 2.54 |
| 1194409 | 134 | 102 | 0.16 | 25 | 0.06 | 2.69 |
| 1194410 | 344 | 385 | 0.18 | 28 | 0.08 | 2.53 |
| 1194411 | 321 | 242 | 0.15 | 22 | 0.08 | 2.53 |
| 1194412 | 227 | 333 | 0.17 | 25 | 0.06 | 2.49 |
| 1194413 | 110 | 61 | 0.16 | 24 | 0.10 | 2.79 |
| 1194415 | 143 | 132 | 0.13 | 25 | 0.08 | 2.39 |
| 1194416 | 73 | 107 | 0.11 | 21 | 0.06 | 2.43 |
| 1194417 | 488 | 672 | 0.24 | 23 | 0.05 | 2.43 |
| 1194419 | 72 | 60 | 0.14 | 28 | 0.08 | 2.64 |
| 1194420 | 104 | 86 | 0.15 | 26 | 0.09 | 2.72 |
| 1194421 | 548 | 502 | 0.26 | 26 | 0.12 | 2.99 |
| 1194423 | 255 | 443 | 0.11 | 25 | 0.04 | 1.54 |
| 1194424 | 325 | 423 | 0.14 | 26 | 0.09 | 2.48 |
| 1194425 | 447 | 490 | 0.18 | 25 | 0.10 | 2.95 |
| 1194426 | 320 | 298 | 0.21 | 26 | 0.10 | 2.80 |
| 1194427 | 147 | 194 | 0.18 | 22 | 0.08 | 2.75 |

Body weights of CD-1 mice were measured at days 1 and 39, and the average body weight for each group is presented in the table below. Liver, kidney and spleen weights were measured at the end of the study and are presented in the table below. Modified oligonucleotides that caused any changes in organ weights outside the expected range for modified oligonucleotides were excluded from further studies.

TABLE 123

Body and organ weights (in grams)

| Compound No. | Body Weight (g) Day 1 | Body Weight (g) Day 39 | Liver (g) | Kidney (g) | Spleen (g) |
|---|---|---|---|---|---|
| Saline | 33 | 38 | 2.0 | 0.6 | 0.1 |
| 1194402 | 35 | 41 | 2.3 | 0.6 | 0.1 |
| 1194403 | 32 | 37 | 2.2 | 0.5 | 0.1 |
| 1194404 | 33 | 39 | 2.4 | 0.6 | 0.2 |
| 1194405 | 35 | 41 | 2.7 | 0.6 | 0.1 |
| 1194406 | 34 | 43 | 2.7 | 0.7 | 0.1 |
| 1194407 | 32 | 38 | 2.1 | 0.6 | 0.1 |
| 1194408 | 33 | 39 | 2.6 | 0.7 | 0.2 |
| 1194409 | 32 | 39 | 2.7 | 0.6 | 0.1 |
| 1194410 | 35 | 41 | 2.9 | 0.6 | 0.2 |
| 1194411 | 35 | 41 | 2.9 | 0.6 | 0.1 |
| 1194412 | 32 | 38 | 2.7 | 0.6 | 0.2 |
| 1194413 | 32 | 39 | 2.3 | 0.6 | 0.1 |
| 1194415 | 33 | 37 | 2.2 | 0.6 | 0.2 |
| 1194416 | 34 | 39 | 2.3 | 0.6 | 0.1 |
| 1194417 | 35 | 41 | 2.3 | 0.6 | 0.2 |
| 1194419 | 33 | 37 | 2.1 | 0.5 | 0.1 |
| 1194420 | 33 | 38 | 2.2 | 0.6 | 0.1 |
| 1194421 | 37 | 42 | 2.7 | 0.6 | 0.1 |
| 1194423 | 33 | 39 | 2.7 | 0.6 | 0.2 |
| 1194424 | 33 | 41 | 2.8 | 0.6 | 0.2 |
| 1194425 | 37 | 41 | 2.0 | 0.6 | 0.1 |
| 1194426 | 35 | 41 | 2.7 | 0.6 | 0.2 |
| 1194427 | 34 | 41 | 2.9 | 0.6 | 0.1 |

Study 3

Groups of two 8-to-10-week-old male CD-1 mice were injected subcutaneously once (for a total of 1 treatment) with 50 mg/kg of modified oligonucleotides. One group of two male CD-1 mice was injected with saline. Mice were euthanized 4 days following administration.

To evaluate the effect of modified oligonucleotides on liver and kidney function, plasma levels of aspartate aminotransferase (AST), alanine aminotransferase (ALT), total bilirubin (TBIL), blood urea nitrogen (BUN), creatinine (CRT) and albumin were measured using an automated clinical chemistry analyzer (Hitachi Olympus AU400c, Melville, NY). The results are presented in the table below.

Assays include two animals in a group, except where the symbol "‡" indicates that only 1 animal was used for a specific assay. Modified oligonucleotides that caused changes in the levels of any of the liver or kidney function markers outside the expected range for modified oligonucleotides were excluded in further studies.

TABLE 124

Plasma chemistry markers in male CD-1 mice

| Compound No. | AST (IU/L) | ALT (IU/L) | TBIL (mg/dL) | BUN (mg/dL) | CRT (mg/dL) | Albumin (mg/dL) |
|---|---|---|---|---|---|---|
| saline | 81 | 63 | 0.13 | 18 | 0.12 | 2.5 |
| 1194483 | 1073 | 1351 | 0.78 | 19 | 0.13 | 2.58 |
| 1194484 | 5261 | 6171 | 4.19 | 15 | 0.13 | 2.46 |
| 1194486 | 112 | 115 | 0.17 | 19 | 0.14 | 2.85 |
| 1194487‡ | 2747 | 3998 | 5.21 | 16 | 0.2 | 2.91 |
| 1194488 | 68 | 46 | 0.14 | 25 | 0.14 | 2.92 |
| 1194489 | 43 | 38 | 0.16 | 23 | 0.13 | 2.48 |
| 1194490 | 61 | 62 | 0.13 | 21 | 0.13 | 2.74 |
| 1194491 | 59 | 77 | 0.16 | 21 | 0.16 | 2.85 |
| 1194492 | 47 | 26 | 0.13 | 23 | 0.14 | 2.59 |
| 1194493 | 114 | 141 | 0.15 | 21 | 0.15 | 2.77 |
| 1194494‡ | 2255 | 3189 | 3.49 | 25 | 0.09 | 2.25 |
| 1194495 | 3848 | 3311 | 1.48 | 19 | 0.15 | 2.56 |
| 1194496 | 839 | 3491 | 2.8 | 21 | 0.14 | 2.37 |
| 1194497 | 3145 | 3724 | 0.77 | 20 | 0.17 | 2.53 |
| 1194498 | 229 | 251 | 0.17 | 15 | 0.12 | 2.14 |
| 1194499 | 519 | 464 | 0.93 | 26 | 0.18 | 2.85 |
| 1194500 | 58 | 52 | 0.16 | 21 | 0.12 | 2.61 |
| 1194501 | 60 | 30 | 0.13 | 21 | 0.14 | 2.69 |
| 1194502 | 45 | 30 | 0.15 | 21 | 0.14 | 2.61 |
| 1194503 | 57 | 38 | 0.14 | 19 | 0.14 | 2.68 |
| 1194504 | 47 | 53 | 0.15 | 20 | 0.13 | 2.63 |
| 1194505‡ | 109 | 183 | 0.15 | 23 | 0.16 | 3.06 |
| 1194506 | 63 | 96 | 0.14 | 25 | 0.13 | 2.86 |
| 1194507 | 124 | 198 | 0.16 | 22 | 0.14 | 2.41 |
| 1194508 | 1291 | 797 | 0.3 | 17 | 0.14 | 2.81 |
| 1194509 | 6147 | 5321 | 3.17 | 18 | 0.18 | 2.99 |
| 1194510 | 322 | 505 | 0.21 | 19 | 0.15 | 2.83 |
| 1194512‡ | 2308 | 5902 | 1.98 | 18 | 0.09 | 2.52 |
| 1194513 | 87 | 112 | 0.21 | 20 | 0.14 | 2.42 |
| 1194514 | 60 | 63 | 0.13 | 19 | 0.14 | 2.52 |
| 1194515 | 90 | 116 | 0.14 | 23 | 0.13 | 2.52 |
| 1194516 | 54 | 47 | 0.15 | 21 | 0.16 | 2.62 |
| 1194517 | 102 | 102 | 0.14 | 17 | 0.16 | 2.54 |
| 1194518 | 78 | 83 | 0.15 | 22 | 0.13 | 2.62 |
| 1194519 | 43 | 32 | 0.19 | 19 | 0.12 | 2.66 |
| 1194520 | 84 | 61 | 0.12 | 20 | 0.15 | 2.56 |
| 1194572 | 148 | 153 | 0.14 | 22 | 0.11 | 2.54 |
| 1194573 | 71 | 50 | 0.16 | 18 | 0.14 | 2.6 |
| 1194574‡ | 324 | 428 | 0.11 | 25 | 0.13 | 2.77 |
| 1194575‡ | 6483 | 7128 | 6.54 | 27 | 0.14 | 2.39 |
| 1194576 | 2701 | 1943 | 6.15 | 30 | 0.32 | 2.44 |
| 1194578 | N/A | 1182‡ | 5.22 | 85 | 0.69 | 2.63 |
| 1194579 | 4055 | 6429 | 4.34 | 25 | 0.18 | 2.83 |
| 1194580‡ | 3302 | 4048 | 6.96 | 24 | 0.2 | 2.51 |
| 1194581 | 6176 | 6185 | 5.21 | 22 | 0.21 | 3.23 |
| 1194582 | 1160‡ | 16‡ | 3.86 | 32 | 0.32 | 3.31 |
| 1194583‡ | N/A | N/A | 5.19 | 27 | 0.19 | 3.44 |

Study 4

Groups of four 7-to-8-week-old male CD-1 mice were injected subcutaneously once per week for 6 weeks (for a total of 6 treatments) with 40 mg/kg of modified oligonucleotides. One group of four male CD-1 mice was injected with saline. Mice were euthanized 2 days following final administration.

To evaluate the effect of modified oligonucleotides on liver and kidney function, plasma levels of aspartate aminotransferase (AST), alanine aminotransferase (ALT), total bilirubin (TBIL), blood urea nitrogen (BUN), creatinine (CRT) and albumin were measured using an automated clinical chemistry analyzer (Hitachi Olympus AU400c, Melville, NY). The results are presented in the table below.

Assays include four animals in a group, except where the symbol "‡" indicates that 3 animals or less was used for a specific assay. Modified oligonucleotides that caused changes in the levels of any of the liver or kidney function markers outside the expected range for modified oligonucleotides were excluded in further studies.

TABLE 125

Plasma chemistry markers in male CD-1 mice

| Compound No. | AST (IU/L) | ALT (IU/L) | TBIL (mg/dL) | BUN (mg/dL) | CRT (mg/dL) | Albumin (mg/dL) |
|---|---|---|---|---|---|---|
| saline | 74 | 57 | 0.24 | 20 | 0.11 | 3.07 |
| 1194343 | 767 | 1036 | 0.41 | 16 | 0.10 | 2.87 |
| 1194345 | 165 | 163 | 0.20 | 23 | 0.12 | 2.75 |
| 1194346 | 826 | 955 | 0.25 | 25 | 0.16 | 3.06 |
| 1194347 | 965 | 1210 | 0.22 | 23 | 0.12 | 3.01 |
| 1194348 | 1886 | 3635 | 0.55 | 24 | 0.15 | 3.15 |
| 1194349 | 140 | 209 | 0.19 | 22 | 0.12 | 2.75 |
| 1194350 | 1342 | 1861 | 0.24 | 23 | 0.13 | 2.72 |
| 1194357 | 66 | 46 | 0.13 | 25 | 0.14 | 2.61 |
| 1194358 | 54 | 59 | 0.16 | 24 | 0.15 | 2.99 |
| 1194359 | 132 | 202 | 0.16 | 22 | 0.11 | 2.66 |
| 1194360 | 119 | 263 | 0.15 | 19 | 0.08 | 2.57 |
| 1194361 | 596 | 740 | 0.21 | 27 | 0.09 | 2.83 |
| 1194363‡ | 441 | 604 | 0.19 | 22 | 0.11 | 3.08 |
| 1194370 | 502 | 572 | 0.16 | 21 | 0.09 | 2.74 |
| 1194371 | 58 | 53 | 0.18 | 22 | 0.09 | 2.85 |
| 1194372 | 510 | 646 | 0.27 | 21 | 0.09 | 2.88 |
| 1194373 | 677 | 963 | 0.24 | 20 | 0.08 | 2.87 |
| 1194374 | 1530 | 2506 | 0.20 | 23 | 0.09 | 2.99 |
| 1194375 | 544 | 815 | 0.18 | 19 | 0.09 | 2.81 |
| 1194376 | 251 | 490 | 0.16 | 19 | 0.06 | 2.54 |
| 1194377 | 438 | 704 | 0.18 | 23 | 0.09 | 2.75 |
| 1194429 | 1282 | 1188 | 0.36 | 21 | 0.06 | 2.80 |
| 1194430 | 558 | 820 | 0.18 | 20 | 0.11 | 2.87 |

Body weights of CD-1 mice were measured at days 1 and 35, and the average body weight for each group is presented in the table below. Liver, kidney and spleen weights were measured at the end of the study and are presented in the table below. Modified oligonucleotides that caused any changes in organ weights outside the expected range for modified oligonucleotides were excluded from further studies.

TABLE 126

Body and organ weights (in grams)

| Compound No. | Body Weight (g) Day 1 | Body Weight (g) Day 35 | Liver (g) | Kidney (g) | Spleen (g) |
|---|---|---|---|---|---|
| Saline | 31 | 39 | 2.0 | 0.6 | 0.1 |
| 1194343 | 31 | 37 | 2.3 | 0.5 | 0.1 |
| 1194345 | 33 | 40 | 2.6 | 0.5 | 0.1 |
| 1194346 | 30 | 36 | 2.8 | 0.5 | 0.1 |
| 1194347 | 34 | 39 | 3.1 | 0.6 | 0.2 |
| 1194348 | 33 | 37 | 3.2 | 0.5 | 0.1 |
| 1194349 | 32 | 38 | 2.6 | 0.5 | 0.1 |
| 1194350 | 32 | 39 | 3.3 | 0.6 | 0.2 |
| 1194357 | 31 | 36 | 2.2 | 0.5 | 0.2 |
| 1194358 | 33 | 39 | 2.6 | 0.5 | 0.1 |
| 1194359 | 31 | 36 | 2.3 | 0.5 | 0.1 |
| 1194360 | 31 | 36 | 2.3 | 0.5 | 0.2 |
| 1194361 | 33 | 37 | 2.7 | 0.5 | 0.1 |
| 1194363 | 31 | 35 | 3.4 | 0.5 | 0.2 |
| 1194370 | 32 | 36 | 2.1 | 0.5 | 0.2 |
| 1194371 | 32 | 38 | 2.1 | 0.5 | 0.1 |
| 1194372 | 31 | 36 | 2.3 | 0.5 | 0.1 |
| 1194373 | 32 | 36 | 2.3 | 0.5 | 0.1 |
| 1194374 | 32 | 38 | 3.1 | 0.6 | 0.2 |
| 1194375 | 31 | 37 | 2.9 | 0.5 | 0.2 |
| 1194376 | 31 | 37 | 2.3 | 0.5 | 0.1 |

TABLE 126-continued

Body and organ weights (in grams)

| Compound No. | Body Weight (g) Day 1 | Body Weight (g) Day 35 | Liver (g) | Kidney (g) | Spleen (g) |
|---|---|---|---|---|---|
| 1194377 | 33 | 39 | 2.8 | 0.5 | 0.2 |
| 1194429 | 31 | 36 | 2.7 | 0.5 | 0.3 |
| 1194430 | 32 | 36 | 2.5 | 0.4 | 0.1 |

Example 11: Tolerability of Modified Oligonucleotides Targeting Human FXII in Sprague-Dawley Rats Sprague-Dawley rats are a multipurpose model used for safety and efficacy evaluations. The rats were treated with Ionis modified oligonucleotides described in the Examples above and evaluated for changes in the levels of various plasma chemistry markers.

Study 1

Groups of 4 Sprague-Dawley rats each were weekly injected subcutaneously with 80 mg/kg of Ionis oligonucleotide for 6 weeks (total 6 doses). The rats were euthanized; and organs, urine and plasma were harvested for further analysis 3 days after the last dose.

Plasma Chemistry Markers

To evaluate the effect of Ionis oligonucleotides on hepatic function, plasma levels of transaminases were measured using an automated clinical chemistry analyzer (Hitachi Olympus AU400c, Melville, NY). Plasma levels of ALT (alanine transaminase) and AST (aspartate transaminase) were measured and the results are presented in the table below expressed in IU/L. Plasma levels of total bilirubin (TBIL), creatinine (CREA), albumin (ALB), and Blood Urea Nitrogen (BUN) were also measured using the same clinical chemistry analyzer and the results are also presented in the table below. Ionis modified oligonucleotides that caused changes in the levels of any markers of liver function outside the expected range for modified oligonucleotides were excluded in further studies. In some cases, where less than 4 samples were available in a group, the compounds are marked with the symbol "‡".

TABLE 127

Plasma chemistry markers in Sprague-Dawley rats

| Compound No. | AST (IU/L) | ALT (IU/L) | TBIL (mg/dL) | BUN (mg/dL) | CREA (mg/dL) | ALB (mg/dL) |
|---|---|---|---|---|---|---|
| Saline | 68 | 41 | 0.16 | 17 | 0.21 | 3.13 |
| 1194380 | 89 | 56 | 0.28 | 19 | 0.26 | 3.03 |
| 1194383 | 198 | 158 | 0.22 | 17 | 0.22 | 3.18 |
| 1194384‡ | 52 | 24 | 0.12 | 17 | 0.18 | 2.93 |
| 1194388 | 244 | 80 | 0.34 | 17 | 0.15 | 2.22 |
| 1194389 | 157 | 103 | 0.20 | 27 | 0.59 | 3.31 |
| 1194392 | 64 | 29 | 0.18 | 18 | 0.20 | 3.18 |
| 1194393 | 59 | 32 | 0.15 | 16 | 0.23 | 3.19 |
| 1194394 | 58 | 28 | 0.12 | 17 | 0.20 | 3.03 |
| 1194395 | 154 | 83 | 0.20 | 17 | 0.23 | 2.99 |
| 1194402 | 82 | 64 | 0.17 | 19 | 0.20 | 3.23 |
| 1194403 | 68 | 37 | 0.17 | 16 | 0.22 | 3.13 |

Blood obtained from rat groups at week 6 were sent to IDEXX BioResearch for measurement of blood cell counts. Counts taken include red blood cell (RBC) count, white blood cell (WBC) count, hemoglobin (HGB), hematocrit (HCT), Mean corpuscular volume (MCV), mean corpuscular hemoglobin (MCH), mean corpuscular hemoglobin concentration (MCHC), and individual white blood cell counts, such as that of monocytes (MON), neutrophils (NEU), lymphocytes (LYM), and platelets (PLT). The results are presented in the tables below. Ionis oligonucleotides that caused changes in the blood cell count outside the expected range for modified oligonucleotides were excluded in further studies.

TABLE 128

Blood Cell Count in Sprague-Dawley Rats

| Compound No. | WBC (/nL) | RBC (/pL) | HGB (g/dL) | HCT (%) | MCV (fL) | MCH (pg) | MCHC (%) | NEU (%) | LYM (%) | MON (%) | PLT (/nL) |
|---|---|---|---|---|---|---|---|---|---|---|---|
| Saline | 11 | 8 | 15 | 44 | 52 | 18 | 35 | 17 | 78 | 4 | 786 |
| 1194380 | 5 | 9 | 15 | 44 | 52 | 18 | 34 | 16 | 77 | 5 | 981 |
| 1194383 | 10 | 9 | 17 | 48 | 51 | 18 | 35 | 12 | 80 | 5 | 916 |
| 1194384 | 8 | 9 | 15 | 44 | 51 | 18 | 35 | 15 | 79 | 4 | 958 |
| 1194388 | 6 | 5 | 10 | 34 | 68 | 21 | 31 | 19 | 74 | 6 | 229 |
| 1194389 | 10 | 9 | 16 | 44 | 52 | 18 | 36 | 16 | 79 | 4 | 1080 |
| 1194392 | 7 | 8 | 15 | 44 | 53 | 18 | 35 | 13 | 83 | 3 | 792 |
| 1194393 | 7 | 9 | 16 | 46 | 53 | 18 | 35 | 19 | 74 | 5 | 714 |
| 1194394 | 5 | 8 | 14 | 41 | 54 | 18 | 34 | 8 | 88 | 2 | 513 |
| 1194395 | 10 | 9 | 15 | 42 | 49 | 17 | 35 | 13 | 80 | 5 | 792 |
| 1194402 | 8 | 9 | 16 | 45 | 50 | 17 | 35 | 9 | 86 | 3 | 800 |
| 1194403 | 6 | 9 | 15 | 44 | 51 | 18 | 35 | 17 | 78 | 4 | 939 |

To evaluate the effect of Ionis oligonucleotides on kidney function, urinary levels of micro total protein (MTP) and creatinine were measured using an automated clinical chemistry analyzer (Hitachi Olympus AU400c, Melville, NY). The ratios of MTP to creatinine (MTP/C ratio) are presented in the table below. Ionis oligonucleotides that caused changes in the levels of the ratio outside the expected range for modified oligonucleotides were excluded in further studies.

TABLE 129

MTP to creatinine ratio in Sprague-Dawley rats

| Compound No. | MTP/C Ratio |
|---|---|
| saline | 1.7 |
| 1194380 | 1.9 |
| 1194383 | 2.5 |
| 1194384 | 2.5 |
| 1194388 | 2.4 |
| 1194389 | 1.9 |
| 1194392 | 1.6 |
| 1194393 | 1.7 |
| 1194394 | 1.9 |
| 1194395 | 1.9 |
| 1194402 | 2.0 |
| 1194403 | 1.8 |

Body weights of rats were measured at days 1 and 38, and the average body weight for each group is presented in the table below. Liver, spleen and kidney weights were measured at the end of the study, and are presented in the table below. Ionis oligonucleotides that caused any changes in organ weights outside the expected range for modified oligonucleotides were excluded from further studies.

TABLE 130

Body and organ weights (g)

| Compound No. | Body Weight (g) Day 1 | Body Weight (g) Day 38 | Liver Weight (g) | Kidney Weight (g) | Spleen Weight (g) |
|---|---|---|---|---|---|
| Saline | 266 | 424 | 18 | 3.4 | 1.0 |
| 1194380 | 255 | 378 | 17 | 3.1 | 1.1 |
| 1194383 | 260 | 370 | 16 | 3.3 | 1.2 |
| 1194384 | 256 | 396 | 17 | 3.5 | 1.4 |
| 1194388 | 256 | 346 | 27 | 3.4 | 4.8 |
| 1194389 | 257 | 398 | 18 | 3.3 | 1.4 |
| 1194392 | 256 | 387 | 19 | 3.3 | 1.5 |
| 1194393 | 245 | 363 | 16 | 2.8 | 1.0 |
| 1194394 | 265 | 389 | 18 | 3.5 | 1.9 |
| 1194395 | 264 | 377 | 14 | 3.2 | 1.3 |
| 1194402 | 249 | 335 | 13 | 2.7 | 1.1 |
| 1194403 | 260 | 387 | 16 | 3.4 | 1.1 |

Study 2

Groups of 4 Sprague-Dawley rats each were weekly injected subcutaneously with 80 mg/kg of Ionis oligonucleotide for 6 weeks (total 6 doses). The rats were euthanized; and organs, urine and plasma were harvested for further analysis 3 days after the last dose.

Plasma Chemistry Markers

To evaluate the effect of Ionis oligonucleotides on hepatic function, plasma levels of transaminases were measured using an automated clinical chemistry analyzer (Hitachi Olympus AU400c, Melville, NY). Plasma levels of ALT (alanine transaminase) and AST (aspartate transaminase) were measured and the results are presented in the table below expressed in IU/L. Plasma levels of total bilirubin (TBIL), creatinine (CREA), albumin (ALB), and Blood Urea Nitrogen (BUN) were also measured using the same clinical chemistry analyzer and the results are also presented in the table below. Ionis modified oligonucleotides that caused changes in the levels of any markers of liver function outside the expected range for modified oligonucleotides were excluded in further studies. In some cases, where less than 4 samples were available in a group, the compounds are marked with the symbol "‡".

TABLE 131

Plasma chemistry markers in Sprague-Dawley rats

| Compound No. | AST (IU/L) | ALT (IU/L) | TBIL (mg/dL) | BUN (mg/dL) | CREA (mg/dL) | ALB (mg/dL) |
|---|---|---|---|---|---|---|
| Saline | 81 | 49 | 0.16 | 15 | 0.22 | 3.11 |
| 1194404 | 99 | 47.5 | 0.22 | 18.375 | 0.28 | 3.21 |
| 1194405 | 853 | 783 | 0.28 | 19 | 0.30 | 3.32 |
| 1194406 | 96 | 50 | 0.16 | 16 | 0.21 | 3.40 |
| 1194407 | 71 | 34 | 0.15 | 17 | 0.24 | 3.20 |
| 1194408 | 223 | 179 | 0.23 | 16 | 0.24 | 3.49‡ |
| 1194409 | 169 | 133 | 0.24 | 17 | 0.22 | 3.30 |
| 1194413‡ | 209 | 167 | 0.28 | 17 | 0.21 | 3.27 |
| 1194415 | 61 | 41 | 0.14 | 17 | 0.21 | 3.44 |
| 1194416‡ | 91 | 57 | 0.16 | 17 | 0.22 | 3.47 |
| 1194419 | 105 | 48 | 0.16 | 15 | 0.23 | 3.32 |
| 1194420 | 84 | 52 | 0.13 | 16 | 0.22 | 3.36 |
| 1194427 | 113 | 71 | 0.18 | 14 | 0.22 | 3.65‡ |

Blood obtained from rat groups at week 6 were sent to IDEXX BioResearch for measurement of blood cell counts. Counts taken include red blood cell (RBC) count, white blood cell (WBC) count, hemoglobin (HGB), hematocrit (HCT), Mean corpuscular volume (MCV) mean corpuscular hemoglobin (MCH), mean corpuscular hemoglobin concentration (MCHC), and individual white blood cell counts, such as that of monocytes (MON), neutrophils (NEU), lymphocytes (LYM), and platelets (PLT). The results are presented in the tables below. Ionis oligonucleotides that caused changes in the blood cell count outside the expected range for modified oligonucleotides were excluded in further studies.

TABLE 132

Blood Cell Count in Sprague-Dawley Rats

| Compound No. | WBC (/nL) | RBC (/pL) | HGB (g/dL) | HCT (%) | MCV (fL) | MCH (pg) | MCHC (%) | NEU (%) | LYM (%) | MON (%) | PLT (/nL) |
|---|---|---|---|---|---|---|---|---|---|---|---|
| Saline | 12 | 8 | 15 | 43 | 55 | 19 | 35 | 17 | 78 | 5 | 882 |
| 1194404 | 13 | 8 | 15 | 43 | 53 | 19 | 35 | 10 | 86 | 4 | 868 |
| 1194405 | 10 | 9 | 16 | 44 | 52 | 18 | 35 | 10 | 77 | 12 | 909 |
| 1194406 | 11 | 8 | 15 | 44 | 52 | 18 | 35 | 11 | 82 | 6 | 867 |
| 1194407 | 11 | 8 | 15 | 44 | 54 | 19 | 35 | 12 | 83 | 4 | 817 |
| 1194408 | 9 | 8 | 16 | 45 | 54 | 19 | 35 | 14 | 78 | 7 | 918 |
| 1194409 | 10 | 8 | 15 | 43 | 55 | 19 | 35 | 8 | 86 | 6 | 735 |
| 1194413‡ | 8 | 8 | 15 | 44 | 55 | 19 | 35 | 12 | 79 | 8 | 798 |
| 1194415 | 8 | 8 | 16 | 45 | 54 | 19 | 35 | 10 | 82 | 7 | 855 |
| 1194416 | 9 | 8 | 16 | 45 | 53 | 19 | 35 | 10 | 83 | 6 | 1093 |
| 1194419 | 5 | 8 | 15 | 42 | 54 | 19 | 35 | 11 | 81 | 8 | 813 |
| 1194420 | 8 | 9 | 16 | 45 | 53 | 19 | 35 | 13 | 80 | 5 | 835 |
| 1194427 | 12 | 8 | 16 | 47 | 56 | 19 | 35 | 13 | 80 | 6 | 1003 |

To evaluate the effect of Ionis oligonucleotides on kidney function, urinary levels of micro total protein (MTP) and creatinine were measured using an automated clinical chemistry analyzer (Hitachi Olympus AU400c, Melville, NY). The ratios of MTP to creatinine (MTP/C ratio) are presented in the table below. Ionis oligonucleotides that caused changes in the levels of the ratio outside the expected range for modified oligonucleotides were excluded in further studies.

TABLE 133

MTP to creatinine ratio in Sprague-Dawley rats

| Compound No. | MTP/C Ratio |
|---|---|
| saline | 0.8 |
| 1194404 | 1.1 |
| 1194405 | 1.6 |
| 1194406 | 1.5 |
| 1194407 | 1.8 |
| 1194408 | 1.9 |
| 1194409 | 1.5 |
| 1194413 | 1.4 |
| 1194415 | 2.0 |
| 1194416 | 1.4 |
| 1194419 | 2.0 |
| 1194420 | 2.3 |
| 1194427 | 2.6 |

Body weights of rats were measured at days 1 and 35, and the average body weight for each group is presented in the table below. Liver, spleen and kidney weights were measured at the end of the study, and are presented in the table below. Ionis oligonucleotides that caused any changes in organ weights outside the expected range for modified oligonucleotides were excluded from further studies.

TABLE 134

Body and organ weights (g)

| Compound No. | Body Weight (g) Day 1 | Body Weight (g) Day 35 | Liver Weight (g) | Kidney Weight (g) | Spleen Weight (g) |
|---|---|---|---|---|---|
| Saline | 219 | 433 | 17 | 3.8 | 4.4 |
| 1194404 | 213 | 391 | 15 | 3.3 | 5.5 |
| 1194405 | 210 | 357 | 16 | 3.3 | 4.4 |
| 1194406 | 218 | 388 | 16 | 3.6 | 4.7 |
| 1194407 | 227 | 410 | 17 | 3.9 | 5.0 |
| 1194408 | 222 | 390 | 15 | 3.6 | 4.8 |
| 1194409 | 216 | 376 | 16 | 3.7 | 5.3 |
| 1194413* | 207 | 399 | 17 | 4.0 | 4.2 |
| 1194415 | 220 | 382 | 15 | 3.5 | 3.9 |
| 1194416 | 218 | 369 | 13 | 3.3 | 4.7 |
| 1194419 | 218 | 388 | 16 | 3.2 | 3.6 |
| 1194420 | 219 | 392 | 16 | 3.6 | 4.6 |
| 1194427 | 204 | 375 | 15 | 3.2 | 4.0 |

Study 3

Groups of 4 Sprague-Dawley rats each were weekly injected subcutaneously with 40 mg/kg of Ionis oligonucleotide for 6 weeks (total 6 doses). A group of 4 rats were treated subcutaneously with 80 mg/kg of Compound No. 1194391. The rats were euthanized; and organs, urine and plasma were harvested for further analysis 2 days after the last dose.

Plasma Chemistry Markers

To evaluate the effect of Ionis oligonucleotides on hepatic function, plasma levels of transaminases were measured using an automated clinical chemistry analyzer (Hitachi Olympus AU400c, Melville, NY). Plasma levels of ALT (alanine transaminase) and AST (aspartate transaminase) were measured and the results are presented in the table below expressed in IU/L. Plasma levels of total bilirubin (TBIL), creatinine (CREA), albumin (ALB), and Blood Urea Nitrogen (BUN) were also measured using the same clinical chemistry analyzer and the results are also presented in the table below. Ionis modified oligonucleotides that caused changes in the levels of any markers of liver function outside the expected range for modified oligonucleotides were excluded in further studies.

TABLE 135

Plasma chemistry markers in Sprague-Dawley rats

| Compound No. | AST (IU/L) | ALT (IU/L) | TBIL (mg/dL) | BUN (mg/dL) | CREA (mg/dL) | ALB (mg/dL) |
|---|---|---|---|---|---|---|
| Saline | 65 | 52 | 0.16 | 15 | 0.23 | 3.31 |
| 1194345 | 122 | 52 | 0.15 | 19 | 0.25 | 2.81 |
| 1194349 | 59 | 38 | 0.16 | 16 | 0.27 | 3.54 |
| 1194357 | 78 | 50 | 0.16 | 16 | 0.28 | 3.67 |
| 1194358 | 82 | 51 | 0.18 | 16 | 0.29 | 3.88 |
| 1194359 | 70 | 41 | 0.15 | 15 | 0.28 | 3.65 |
| 1194360 | 269 | 92 | 0.35 | 20 | 0.27 | 2.66 |
| 1194371 | 125 | 85 | 0.20 | 17 | 0.25 | 2.74 |
| 1194377 | 1054 | 319 | 1.04 | 16 | 0.35 | 3.18 |
| 1194430 | 1195 | 379 | 1.04 | 16 | 0.26 | 3.39 |
| 1194391 | 83 | 65 | 0.17 | 15 | 0.21 | 3.39 |

Blood obtained from rat groups at week 6 were sent to IDEXX BioResearch for measurement of blood cell counts. Counts taken include red blood cell (RBC) count, white blood cell (WBC) count, hemoglobin (HGB), hematocrit (HCT), Mean corpuscular volume (MCV) mean corpuscular hemoglobin (MCH), mean corpuscular hemoglobin concentration (MCHC), and individual white blood cell counts, such as that of monocytes (MON), neutrophils (NEU), lymphocytes (LYM), and platelets (PLT). The results are presented in the tables below. Ionis oligonucleotides that caused changes in the blood cell count outside the expected range for modified oligonucleotides were excluded in further studies.

TABLE 136

Blood Cell Count in Sprague-Dawley Rats

| Compound No. | WBC (/nL) | RBC (/pL) | HGB (g/dL) | HCT (%) | MCV (fL) | MCH (pg) | MCHC (%) | NEU (%) | LYM (%) | MON (%) | PLT (/nL) |
|---|---|---|---|---|---|---|---|---|---|---|---|
| Saline | 9 | 8 | 16 | 47 | 58 | 19 | 34 | 16 | 81 | 2 | 749 |
| 1194345 | 12 | 7 | 14 | 42 | 61 | 20 | 33 | 9 | 87 | 3 | 687 |
| 1194349 | 10 | 8 | 15 | 45 | 55 | 19 | 34 | 21 | 75 | 3 | 921 |
| 1194357 | 9 | 8 | 16 | 47 | 57 | 19 | 34 | 10 | 86 | 3 | 814 |
| 1194358 | 11 | 9 | 16 | 47 | 55 | 19 | 34 | 13 | 82 | 4 | 1020 |
| 1194359 | 10 | 8 | 15 | 45 | 55 | 19 | 34 | 13 | 82 | 3 | 887 |
| 1194360 | 16 | 8 | 13 | 38 | 50 | 17 | 34 | 10 | 84 | 6 | 733 |

TABLE 136-continued

Blood Cell Count in Sprague-Dawley Rats

| Compound No. | WBC (/nL) | RBC (/pL) | HGB (g/dL) | HCT (%) | MCV (fL) | MCH (pg) | MCHC (%) | NEU (%) | LYM (%) | MON (%) | PLT (/nL) |
|---|---|---|---|---|---|---|---|---|---|---|---|
| 1194371 | 9 | 8 | 14 | 43 | 56 | 18 | 33 | 19 | 74 | 5 | 910 |
| 1194377 | 9 | 8 | 15 | 43 | 56 | 19 | 34 | 17 | 76 | 6 | 917 |
| 1194430 | 13 | 8 | 14 | 42 | 56 | 19 | 34 | 20 | 73 | 7 | 1241 |
| 1194391 | 8 | 8 | 16 | 46 | 58 | 20 | 34 | 22 | 74 | 3 | 803 |

To evaluate the effect of Ionis oligonucleotides on kidney function, urinary levels of micro total protein (MTP) and creatinine were measured using an automated clinical chemistry analyzer (Hitachi Olympus AU400c, Melville, NY). The ratios of MTP to creatinine (MTP/C ratio) are presented in the table below. Ionis oligonucleotides that caused changes in the levels of the ratio outside the expected range for modified oligonucleotides were excluded in further studies.

TABLE 137

MTP to creatinine ratio in Sprague-Dawley rats

| Compound No. | MTP/C Ratio |
|---|---|
| saline | 1.1 |
| 1194345 | 1.8 |
| 1194349 | 2.9 |
| 1194357 | 2.1 |
| 1194358 | 1.6 |
| 1194359 | 1.8 |
| 1194360 | 1.7 |
| 1194371 | 1.2 |
| 1194377 | 2.4 |
| 1194430 | 2.2 |
| 1194391 | 1.4 |

Body weights of rats were measured at days 1 and 38, and the average body weight for each group is presented in the table below. Liver, spleen and kidney weights were measured at the end of the study, and are presented in the table below. Ionis oligonucleotides that caused any changes in organ weights outside the expected range for modified oligonucleotides were excluded from further studies.

TABLE 138

Body and organ weights (g)

| Compound No. | Body Weight (g) Day 1 | Body Weight (g) Day 38 | Liver Weight (g) | Kidney Weight (g) | Spleen Weight (g) |
|---|---|---|---|---|---|
| Saline | 237 | 450 | 17 | 3.5 | 0.8 |
| 1194345 | 249 | 446 | 20 | 3.8 | 2.3 |
| 1194349 | 232 | 425 | 19 | 3.2 | 1.2 |
| 1194357 | 235 | 409 | 17 | 3.6 | 1.2 |
| 1194358 | 240 | 396 | 16 | 3.3 | 1.2 |
| 1194359 | 249 | 414 | 15 | 3.4 | 1.1 |
| 1194360 | 239 | 385 | 15 | 3.5 | 1.8 |
| 1194371 | 235 | 422 | 19 | 3.5 | 1.4 |
| 1194377 | 243 | 376 | 10 | 3.0 | 1.4 |
| 1194391 | 233 | 414 | 16 | 3.3 | 0.8 |
| 1194430 | 243 | 406 | 13 | 3.7 | 1.5 |

Study 4

Groups of 4 Sprague-Dawley rats each were weekly injected subcutaneously with 40 mg/kg of Ionis oligonucleotide for 6 weeks (total 6 doses). The rats were euthanized; and organs, urine and plasma were harvested for further analysis 3 days after the last dose.

Plasma Chemistry Markers

To evaluate the effect of Ionis oligonucleotides on hepatic function, plasma levels of transaminases were measured using an automated clinical chemistry analyzer (Hitachi Olympus AU400c, Melville, NY). Plasma levels of ALT (alanine transaminase) and AST (aspartate transaminase) were measured and the results are presented in the table below expressed in IU/L. Plasma levels of total bilirubin (TBIL), creatinine (CREA), albumin (ALB), and Blood Urea Nitrogen (BUN) were also measured using the same clinical chemistry analyzer and the results are also presented in the table below. Ionis modified oligonucleotides that caused changes in the levels of any markers of liver function outside the expected range for modified oligonucleotides were excluded in further studies.

TABLE 139

Plasma chemistry markers in Sprague-Dawley rats

| Compound No. | AST (IU/L) | ALT (IU/L) | TBIL (mg/dL) | BUN (mg/dL) | CREA (mg/dL) | ALB (mg/dL) |
|---|---|---|---|---|---|---|
| Saline | 61 | 43 | 0.1 | 16 | 0.3 | 3.4 |
| 1270699 | 86 | 63 | 0.2 | 17 | 0.3 | 3.7 |
| 1270700 | 195 | 157 | 0.3 | 17 | 0.4 | 3.6 |
| 1270701 | 83 | 47 | 0.2 | 15 | 0.3 | 3.6 |
| 1270703 | 113 | 61 | 0.2 | 25 | 0.4 | 3.5 |
| 1270705 | 254 | 246 | 0.2 | 17 | 0.3 | 3.5 |
| 1270707 | 213 | 196 | 0.2 | 18 | 0.3 | 3.6 |
| 1270710 | 130 | 61 | 0.1 | 17 | 0.3 | 3.5 |
| 1270712 | 119 | 80 | 0.2 | 17 | 0.3 | 3.6 |
| 1270714 | 112 | 70 | 0.2 | 22 | 0.3 | 3.3 |
| 1270715 | 337 | 198 | 0.3 | 19 | 0.3 | 3.5 |
| 1270716 | 195 | 92 | 0.2 | 15 | 0.3 | 3.6 |

Blood obtained from rat groups at week 6 were sent to IDEXX BioResearch for measurement of blood cell counts. Counts taken include red blood cell (RBC) count, white blood cell (WBC) count, hemoglobin (HGB), hematocrit (HCT), Mean corpuscular volume (MCV), mean corpuscular hemoglobin (MCH), mean corpuscular hemoglobin concentration (MCHC), and individual white blood cell counts, such as that of monocytes (MON), neutrophils (NEU), lymphocytes (LYM), and platelets (PLT). The results are presented in the tables below. Ionis oligonucleotides that caused changes in the blood cell count outside the expected range for modified oligonucleotides were excluded in further studies.

TABLE 140

Blood Cell Count in Sprague-Dawley Rats

| Compound No. | WBC (/nL) | RBC (/pL) | HGB (g/dL) | HCT (%) | MCV (fL) | MCH (pg) | MCHC (%) | NEU (%) | LYM (%) | MON (%) | PLT (/nL) |
|---|---|---|---|---|---|---|---|---|---|---|---|
| Saline | 6 | 9 | 16 | 47 | 54 | 18 | 33 | 15 | 78 | 6 | 804 |
| 1270699 | 7 | 9 | 15 | 45 | 52 | 18 | 34 | 11 | 82 | 6 | 717 |
| 1270700 | 11 | 9 | 15 | 44 | 51 | 18 | 35 | 10 | 83 | 6 | 813 |
| 1270701 | 8 | 9 | 15 | 44 | 51 | 18 | 34 | 13 | 80 | 6 | 814 |
| 1270703 | 9 | 8 | 14 | 43 | 54 | 18 | 33 | 19 | 73 | 6 | 757 |
| 1270705 | 9 | 9 | 15 | 45 | 51 | 18 | 34 | 15 | 76 | 8 | 799 |
| 1270707 | 10 | 9 | 16 | 45 | 52 | 18 | 35 | 10 | 81 | 6 | 939 |
| 1270710 | 13 | 8 | 13 | 39 | 49 | 17 | 34 | 12 | 81 | 6 | 778 |
| 1270712 | 7 | 8 | 14 | 42 | 51 | 17 | 34 | 21 | 69 | 8 | 780 |
| 1270714 | 9 | 9 | 16 | 44 | 50 | 18 | 36 | 19 | 72 | 8 | 754 |
| 1270715 | 13 | 8 | 14 | 42 | 51 | 17 | 34 | 11 | 83 | 5 | 865 |
| 1270716 | 8 | 8 | 14 | 42 | 51 | 17 | 34 | 11 | 80 | 8 | 738 |

To evaluate the effect of Ionis oligonucleotides on kidney function, urinary levels of micro total protein (MTP) and creatinine were measured using an automated clinical chemistry analyzer (Hitachi Olympus AU400c, Melville, NY). The ratios of MTP to creatinine (MTP/C ratio) are presented in the table below. Ionis oligonucleotides that caused changes in the levels of the ratio outside the expected range for modified oligonucleotides were excluded in further studies.

TABLE 141

MTP to creatinine ratio in Sprague-Dawley rats

| Compound No. | MTP/C Ratio |
|---|---|
| saline | 1.0 |
| 1270699 | 2.5 |
| 1270700 | 1.0 |
| 1270701 | 1.6 |
| 1270703 | 1.3 |
| 1270705 | 1.2 |
| 1270707 | 1.8 |
| 1270710 | 2.6 |
| 1270712 | 1.2 |
| 1270714 | 0.9 |
| 1270715 | 3.1 |
| 1270716 | 2.5 |

Body weights of rats were measured at days 1 and 35, and the average body weight for each group is presented in the table below. Liver, spleen and kidney weights were measured at the end of the study, and are presented in the table below. Ionis oligonucleotides that caused any changes in organ weights outside the expected range for modified oligonucleotides were excluded from further studies.

TABLE 142

Body and organ weights (g)

| Compound No. | Body Weight (g) Day 1 | Body Weight (g) Day 35 | Liver Weight (g) | Kidney Weight (g) | Spleen Weight (g) |
|---|---|---|---|---|---|
| Saline | 469 | 529 | 18 | 4.0 | 0.8 |
| 1270699 | 484 | 511 | 22 | 4.3 | 1.6 |
| 1270700 | 496 | 507 | 19 | 4.0 | 1.4 |
| 1270701 | 469 | 513 | 19 | 4.4 | 1.2 |
| 1270703 | 491 | 509 | 19 | 4.6 | 1.4 |
| 1270705 | 499 | 527 | 21 | 4.7 | 1.6 |
| 1270707 | 486 | 500 | 21 | 4.5 | 1.7 |
| 1270710 | 499 | 540 | 22 | 4.6 | 1.5 |
| 1270712 | 500 | 552 | 17 | 4.5 | 1.4 |
| 1270714 | 504 | 548 | 17 | 4.8 | 1.2 |
| 1270715 | 474 | 494 | 19 | 4.0 | 1.7 |
| 1270716 | 477 | 501 | 17 | 4.2 | 1.5 |

Example 12: Activity of Modified Oligonucleotides Complementary to Human FXII in Transgenic Mice, Single Dose A transgenic mouse model was developed in-house using the Fosmid NCBI Clone DB ID: ABC12-49040200E6. The clone was digested at AgeI and NdeI restriction sites to produce a region containing the entire ~23 kb portion of human F12 gene, including regions 12 kb upstream and 4 kb downstream of the F12 gene. The gene fragment was introduced into fertilized eggs from C57Bl/6 mice by pronuclear injection to produce FXII founder lines. Line 16459 was used in the experiments described herein. Human FXII RNA expression is found in the liver and circulating protein is found in plasma.

Study 1
Treatment

The transgenic mice were divided into groups of 2 female mice each for modified oligonucleotide treatment. Groups received subcutaneous injections of modified oligonucleotide at a dose of 2.5 mg/kg twice a week for two weeks (4 treatments). One group of two mice received subcutaneous injections of PBS twice a week for two weeks (4 treatments). The PBS-injected group served as the control group to which oligonucleotide-treated groups were compared.

RNA Analysis 48 hours after the last treatment, mice were sacrificed and RNA was extracted from liver for real-time RTPCR analysis of FXII RNA expression. Human FXII primer probe sets RTS2992 (described herein above) and RTS40528 (described herein above) were used to measure human FXII RNA levels. FXII RNA levels were normalized to total RNA content, as measured by RIBOGREEN®. Reduction of FXII RNA is presented in the tables below as percent FXII RNA relative to the amount in PBS control animals (% control).

TABLE 143

Reduction of human FXII RNA in transgenic mice

| Compound No. | FXII RNA (% control) in liver | |
|---|---|---|
| | RTS2992 | RTS40528 |
| PBS | 100 | 100 |
| 1194343 | 2 | 9 |
| 1194347 | 15 | 20 |

Protein Analysis

Human FXII protein levels in plasma were determined using an Abcam FXII ELISA kit (ab192144). Reduction of FXII protein is presented in the tables below as percent FXII protein relative to the amount in PBS control animals (% control).

TABLE 144

Reduction of human FXII protein in transgenic mice

| Compound No. | FXII protein (% control) in plasma |
|---|---|
| PBS | 100 |
| 1194343 | 0.3 |
| 1194347 | 17 |

Study 2
Treatment

The transgenic mice were divided into groups of 4 mice (2 male and 2 female) each for modified oligonucleotide treatment. Groups received subcutaneous injections of modified oligonucleotide at a dose of 1.5 mg/kg twice a week for two weeks (4 treatments). One group of four mice (2 male and 2 female) received subcutaneous injections of PBS twice a week for two weeks (4 treatments). The PBS-injected group served as the control group to which oligonucleotide-treated groups were compared.

RNA Analysis 48 hours after the last treatment, mice were sacrificed and RNA was extracted from liver for real-time RTPCR analysis of FXII RNA expression. Human FXII primer probe sets RTS2992 (described herein above) and RTS40528 (described herein above) were used to measure human FXII RNA levels. FXII RNA levels were normalized to total RNA content, as measured by RIBOGREEN®. Reduction of FXII RNA is presented in the tables below as percent FXII RNA relative to the amount in PBS treated animals (% control).

TABLE 145

Reduction of human FXII RNA in transgenic mice

| Compound No. | FXII RNA (% control) in liver | |
|---|---|---|
| | RTS2992 | RTS40528 |
| PBS | 100 | 100 |
| 1194380 | 32 | 36 |
| 1194383 | 52 | 58 |
| 1194384 | 32 | 35 |
| 1194389 | 54 | 76 |
| 1194391 | 45 | 57 |
| 1194392 | 48 | 68 |
| 1194393 | 37 | 40 |
| 1194394 | 31 | 41 |
| 1194395 | 21 | 35 |
| 1194402 | 22 | 27 |
| 1194403 | 12 | 10 |
| 1194404 | 17 | 17 |
| 1194406 | 31 | 40 |
| 1194407 | 56 | 76 |
| 1194408 | 21 | 23 |
| 1194409 | 22 | 20 |
| 1194413 | 82 | 80 |
| 1194415 | 83 | 111 |
| 1194416 | 81 | 96 |
| 1194419 | 45 | 54 |
| 1194420 | 61 | 53 |
| 1194427 | 90 | 71 |
| 1194345 | 14 | 12 |
| 1194349 | 10 | 9 |
| 1194357 | 3 | 3 |
| 1194358 | 3 | 2 |
| 1194359 | 6 | 4 |
| 1194360 | 5 | 4 |
| 1194371 | 5 | 6 |
| 1194377 | 12 | 12 |
| 1194430 | 21 | 22 |

Protein Analysis

Human FXII protein levels in plasma were determined using an Abcam FXII ELISA kit (ab192144). Reduction of FXII protein is presented in the tables below as percent FXII protein relative to the amount in PBS treated animals (% control).

TABLE 146

Reduction of human FXII protein in transgenic mice

| Compound No. | FXII protein (% control) in plasma |
|---|---|
| PBS | 100 |
| 1194380 | 23 |
| 1194383 | 41 |
| 1194384 | 24 |
| 1194389 | 56 |
| 1194391 | 36 |
| 1194392 | 38 |
| 1194393 | 27 |
| 1194394 | 20 |
| 1194395 | 12 |
| 1194402 | 14 |
| 1194403 | 4 |
| 1194404 | 9 |
| 1194406 | 23 |
| 1194407 | 42 |
| 1194408 | 16 |
| 1194409 | 15 |
| 1194413 | 61 |
| 1194415 | 80 |
| 1194416 | 72 |
| 1194419 | 42 |
| 1194420 | 61 |
| 1194427 | 87 |
| 1194345 | 11 |
| 1194349 | 3 |
| 1194357 | 1 |
| 1194358 | 0 |
| 1194359 | 1 |
| 1194360 | 2 |
| 1194371 | 1 |
| 1194377 | 9 |
| 1194430 | 20 |

Example 13: Activity of Modified Oligonucleotides Complementary to Human FXII in Transgenic Mice, Multiple Dose A transgenic mouse model was developed in-house using the Fosmid NCBI Clone DB ID: ABC12-49040200E6. The clone was digested at AgeI and NdeI restriction sites to produce a region containing the entire ~23 kb portion of human F12 gene, including regions 12 kb upstream and 4 kb downstream of the F12 gene. The gene fragment was introduced into fertilized eggs from C57Bl/6 mice by pronuclear injection to produce FXII founder lines. Line 16459 was used in the experiments described herein. Human FXII RNA expression is found in the liver and circulating protein is found in plasma.

Study 1

Treatment

The transgenic mice were divided into groups of 2 female mice each for modified oligonucleotide treatment. Groups received subcutaneous injections of modified oligonucleotide at doses indicated in the table below twice a week for two weeks (4 treatments). One group of two mice received subcutaneous injections of PBS twice a week for two weeks (4 treatments). The PBS-injected group served as the control group to which oligonucleotide-treated groups were compared.

RNA Analysis 48 hours after the last treatment, mice were sacrificed and RNA was extracted from liver for real-time RTPCR analysis of FXII RNA expression. Human FXII primer probe set RTS2992 (described herein above) was used to measure human FXII RNA levels. FXII RNA levels were normalized to total RNA content, as measured by RIBOGREEN®. Reduction of FXII RNA is presented in the tables below as percent FXII RNA relative to the amount in PBS treated animals (% control).

TABLE 147

Reduction of human FXII RNA in transgenic mice

| Compound No. | Concentration (mpk) | RTS2992 FXII RNA (% control) in liver | ED50 (mpk) |
|---|---|---|---|
| 1194347 | 0.32 | 75 | 1.292 |
|  | 0.8 | 59 |  |
|  | 2 | 50 |  |
|  | 5 | 14 |  |

Protein Analysis

Human FXII protein levels in plasma were determined using an Abcam FXII ELISA kit (ab192144). Reduction of FXII protein is presented in the tables below as percent FXII protein relative to the amount in PBS treated animals (% control).

TABLE 148

Reduction of human FXII protein in transgenic mice

| Compound No. | Concentration (mpk) | FXII protein (% control) in plasma | ED50 (mpk) |
|---|---|---|---|
| 1194347 | 0.32 | 78 | 1.073 |
|  | 0.8 | 64 |  |
|  | 2 | 31 |  |
|  | 5 | 11 |  |

Study 2

Treatment

The transgenic mice were divided into groups of four mice (2 male and 2 female) each for modified oligonucleotide treatment. Groups received subcutaneous injections of modified oligonucleotide at doses indicated in the table below twice a week for two weeks (4 treatments). One group of four mice (2 male and 2 female) received subcutaneous injections of PBS twice a week for two weeks (4 treatments). The PBS-injected group served as the control group to which oligonucleotide-treated groups were compared.

RNA Analysis 48 hours after the last treatment, mice were sacrificed and RNA was extracted from liver for real-time RTPCR analysis of FXII RNA expression. Human FXII primer probe set RTS2992 (described herein above) was used to measure human FXII RNA levels. FXII RNA levels were normalized to total RNA content, as measured by RIBOGREEN®. Reduction of FXII RNA is presented in the tables below as percent FXII RNA relative to the amount in PBS treated animals (% control).

TABLE 149

Reduction of human FXII RNA in transgenic mice

| Compound No. | Concentration (mpk) | FXII RNA (% control) in liver (RTS2992) | ED50 (mpk) |
|---|---|---|---|
| 1194357 | 0.08 | 60 | 0.07514 |
|  | 0.1 | 33 |  |
|  | 0.2 | 27 |  |
|  | 0.3 | 14 |  |
|  | 0.6 | 8 |  |
|  | 0.9 | 4 |  |
| 1194349 | 0.1 | 60 | 0.4603 |
|  | 0.3 | 61 |  |
|  | 0.9 | 25 |  |
| 1194358 | 0.1 | 47 | 0.08653 |
|  | 0.3 | 18 |  |
|  | 0.9 | 9 |  |
| 1194359 | 0.1 | 80 | 0.1997 |
|  | 0.3 | 36 |  |
|  | 0.9 | 9 |  |
| 1194371 | 0.1 | 114 | 0.2737 |
|  | 0.3 | 35 |  |
|  | 0.9 | 10 |  |
| 1194377 | 0.1 | 91 | 0.5223 |
|  | 0.3 | 70 |  |
|  | 0.9 | 28 |  |
| 1270699 | 0.1 | 79 | 0.1731 |
|  | 0.3 | 31 |  |
|  | 0.9 | 6 |  |
| 1270700 | 0.1 | 57 | 0.1211 |
|  | 0.3 | 21 |  |
|  | 0.9 | 4 |  |
| 1270701 | 0.1 | 38 | 0.1871 |
|  | 0.3 | 41 |  |
|  | 0.9 | 6 |  |
| 1270702 | 0.1 | 59 | 0.1816 |
|  | 0.3 | 22 |  |
|  | 0.9 | 6 |  |
| 1270703 | 0.08 | 76 | 0.2228 |
|  | 0.2 | 71 |  |
|  | 0.6 | 11 |  |
| 1270705 | 0.08 | 62 | 0.113 |
|  | 0.2 | 33 |  |
|  | 0.6 | 12 |  |
| 1270707 | 0.08 | 82 | 0.2085 |
|  | 0.2 | 57 |  |
|  | 0.6 | 14 |  |

TABLE 149-continued

Reduction of human FXII RNA in transgenic mice

| Compound No. | Concentration (mpk) | FXII RNA (% control) in liver (RTS2992) | ED50 (mpk) |
|---|---|---|---|
| 1270710 | 0.08 | 92 | 0.265 |
|  | 0.2 | 61 |  |
|  | 0.6 | 19 |  |
| 1270712 | 0.08 | 92 | 0.3297 |
|  | 0.2 | 63 |  |
|  | 0.6 | 14 |  |
| 1270714 | 0.08 | 57 | 0.3936 |
|  | 0.2 | 47 |  |
|  | 0.6 | 25 |  |
| 1270715 | 0.08 | 69 | 0.3242 |
|  | 0.2 | 57 |  |
|  | 0.6 | 20 |  |
| 1270716 | 0.08 | 58 | 0.3093 |
|  | 0.2 | 52 |  |
|  | 0.6 | 20 |  |

Protein Analysis

Human FXII protein levels in plasma were determined using an Abcam FXII ELISA kit (ab192144). Reduction of FXII protein is presented in the tables below as percent FXII protein relative to the amount in PBS treated animals (% control).

TABLE 150

Reduction of human FXII protein in transgenic mice

| Compound No. | Concentration (mpk) | FXII protein (% control) in plasma | ED50 (mpk) |
|---|---|---|---|
| 1194357 | 0.08 | 67 | 0.065 |
|  | 0.1 | 43 |  |
|  | 0.2 | 25 |  |
|  | 0.3 | 15 |  |
|  | 0.6 | 3 |  |
|  | 0.9 | 6 |  |
| 1194349 | 0.1 | 84 | 0.2799 |
|  | 0.3 | 48 |  |
|  | 0.9 | 13 |  |
| 1194358 | 0.1 | 52 | 0.09148 |
|  | 0.3 | 20 |  |
|  | 0.9 | 5 |  |
| 1194359 | 0.1 | 53 | 0.0959 |
|  | 0.3 | 22 |  |
|  | 0.9 | 3 |  |
| 1194371 | 0.1 | 65 | 0.1356 |
|  | 0.3 | 29 |  |
|  | 0.9 | 3 |  |
| 1194377 | 0.1 | 80 | 0.2882 |
|  | 0.3 | 50 |  |
|  | 0.9 | 16 |  |
| 1270699 | 0.1 | 62 | 0.1153 |
|  | 0.3 | 22 |  |
|  | 0.9 | 4 |  |
| 1270700 | 0.1 | 53 | 0.08752 |
|  | 0.3 | 17 |  |
|  | 0.9 | 1 |  |
| 1270701 | 0.1 | 42 | 0.08131 |
|  | 0.3 | 27 |  |
|  | 0.9 | 5 |  |
| 1270702 | 0.1 | 65 | 0.1331 |
|  | 0.3 | 27 |  |
|  | 0.9 | 4 |  |

TABLE 150-continued

Reduction of human FXII protein in transgenic mice

| Compound No. | Concentration (mpk) | FXII protein (% control) in plasma | ED50 (mpk) |
|---|---|---|---|
| 1270703 | 0.08 | 79 | 0.1572 |
|  | 0.2 | 41 |  |
|  | 0.6 | 7 |  |
| 1270705 | 0.08 | 66 | 0.1174 |
|  | 0.2 | 36 |  |
|  | 0.6 | 7 |  |
| 1270707 | 0.08 | 77 | 0.1668 |
|  | 0.2 | 46 |  |
|  | 0.6 | 8 |  |
| 1270710 | 0.08 | 86 | 0.2288 |
|  | 0.2 | 56 |  |
|  | 0.6 | 13 |  |
| 1270712 | 0.08 | 86 | 0.2467 |
|  | 0.2 | 58 |  |
|  | 0.6 | 16 |  |
| 1270714 | 0.08 | 93 | 0.3053 |
|  | 0.2 | 62 |  |
|  | 0.6 | 24 |  |
| 1270715 | 0.08 | 89 | 0.3739 |
|  | 0.2 | 62 |  |
|  | 0.6 | 37 |  |
| 1270716 | 0.08 | 89 | 0.3447 |
|  | 0.2 | 71 |  |
|  | 0.6 | 25 |  |

Study 3

Treatment

The transgenic mice were divided into groups of four mice (2 male and 2 female) each for modified oligonucleotide treatment. Groups received subcutaneous injections of modified oligonucleotide at doses indicated in the table below twice a week for two weeks (4 treatments). One group of four mice (2 male and 2 female) received subcutaneous injections of PBS twice a week for two weeks (4 treatments). The PBS-injected group served as the control group to which oligonucleotide-treated groups were compared.

RNA Analysis 72 hours after the last treatment, mice were sacrificed and RNA was extracted from liver for real-time RTPCR analysis of FXII RNA expression. Human FXII primer probe sets RTS2992 (described herein above) was used to measure human FXII RNA levels. FXII RNA levels were normalized to total RNA content, as measured by RIBOGREEN®. Reduction of FXII RNA is presented in the tables below as percent FXII RNA relative to the amount in PBS treated animals (% control).

TABLE 151

Reduction of human FXII RNA in transgenic mice

| Compound No. | Concentration (mpk) | RTS2992 FXII RNA (% control) in liver | ED50 (mpk) |
|---|---|---|---|
| 1194371 | 0.075 | 94 | 0.2457 |
|  | 0.15 | 57 |  |
|  | 0.3 | 47 |  |
|  | 0.6 | 22 |  |
|  | 1.2 | 10 |  |

Example 14: Effect of Modified Oligonucleotides on Human FXII mRNA In Vitro, Multiple Doses Modified oligonucleotides selected from the examples above were tested at various doses in Huh7 cells. Cultured Huh7 cells at a density of 20,000 cells per well were transfected by electroporation with various concentrations of modified oligonucleotide as specified in the table below. After a treatment period of approximately 24 hours, total RNA was isolated from the cells, and FXII mRNA levels were measured by quantitative real-time RTPCR. Human FXII primer probe set RTS40528 (described herein above) was used to measure RNA levels. FXII levels were adjusted according to total RNA content, as measured by RIBOGREEN®. Reduction of FXII RNA is presented in the tables below as percent FXII RNA relative to the amount in untreated control cells (% UTC). The half maximal inhibitory concentration ($IC_{50}$) of each modified oligonucleotide was calculated in GraphPad Prism using the log (inhibitor) vs. normalized response—variable slope method.

Four comparator compounds from WO 2017/120397 were added to the study. These include Compound Nos. 1213034, 1358035, 1213030 and 1213029 designated as A-145676, A-145669, A-145668, and A-145667 respectively in WO 2017/120397.

TABLE 152

Dose-dependent reduction of human FXII RNA by modified oligonucleotides

| Compound No. | FXII RNA (% UTC) | | | | | IC50 (µM) |
|---|---|---|---|---|---|---|
| | 10 µM | 2 µM | 0.4 µM | 0.08 µM | 0.016 µM | |
| 1129485 | 7 | 15 | 44 | 81 | 98 | 0.34 |
| 1129486 | 8 | 18 | 51 | 96 | 97 | 0.48 |
| 1207006 | 8 | 10 | 28 | 52 | 84 | 0.1 |
| 1207160 | 17 | 18 | 30 | 58 | 65 | 0.09 |
| 1207161 | 12 | 20 | 27 | 68 | 83 | 0.17 |
| 1207277 | 6 | 9 | 29 | 59 | 84 | 0.13 |
| 1207279 | 12 | 29 | 45 | 80 | 95 | 0.43 |
| 1207393 | 7 | 14 | 26 | 63 | 83 | 0.14 |
| 1213260 | 12 | 18 | 26 | 62 | 87 | 0.15 |
| 1213144 | 8 | 25 | 37 | 71 | 95 | 0.28 |
| Comparator Compounds | | | | | | |
| 1213030 | 43 | 84 | 132 | 132 | 94 | 8.15 |
| 1213034 | 69 | 116 | 139 | 127 | 92 | >10 |
| 1213029 | 63 | 123 | 146 | 130 | 98 | >10 |
| 1358035 | 43 | 93 | 127 | 121 | 104 | 8.59 |

SEQUENCE LISTING (5042 sequences)

SEQ ID NO: 1 - DNA, 2049 bp, Homo sapiens
ctattgatctggactcctggataggcagctggaccaacggacggatgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggagccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgag

SEQ ID NO: 2 - DNA, 7437 bp, Homo sapiens
ctattgatctggactcctggataggcagctggaccaacggacggatgccatgagggctctgctgctcctggggttcctgctggtgagcttggagtcaacactttcggtgagtgctgtgggaaccaggattgtcccaggattgttctggggggtcgctatcacagccatgagccatggcctctgctcatgacctgtgggtccaggtgactaggaggcctatgtggaaaggtgaggccagcccggaaggcccaggcagaggagacagacaaccagactgggtggatacaagggcacagcctgcatttctgggggagatgggccttaagaagacaacggggggaggtagaaagggtttgggtcttgggaagaaatctctgcatttctgggctgtgagaggaagctgcagactagcaacagatcggtggcaggctatgacttatagtcagttccctgccttcttctctcccttgtagattccaccttgggaagcccccaaggagcataagtacaaagctgaagagcacacagtcggtaagtggcctggctcctcctcccgggaacccttgggtggggatgtgtatggtgcagtgtgtgcagtctcagggcagtctagtctagtgcctacctggtgctaggtcttatgcccatgggcactagagtgatcgtgagctgtgtgatccttgagggcagggtatgggctgtgtctaagtgcccacgagcctggctcggagcaggtgcttgagatatgtgctgctggcgccatcacacctgggctcctgccagccttcctcagtttccccagcttctccccttcttttcctttccccagtacgtctcatgggcatcattcatgccacacagaggccagggccttcaatgggcaaggaaggatcaagagcttgtctctggcatctgaatgcctctgaagcccagctttatcacttatgagctgggtgactctgggcgagggatttgagttctccaagcttcaatttccccttctgtgaaaccaggttgataacagtaaacctcttagggttgttgagaagggaaacccatgtgaggtattcagcccatcacctggtgcatggaaatgctttacaaatattagcttttattatgaaactaccttttagatgaagggtacctgccatttcccccttcctcaagctctgccatagctccccattgctttcattcttccagacactaaattacctacatgccaggcatggtggctcatgcctgtaatcccagcactttgggaggccaaggtcggtggatcatgaggtcaggagttcgagaccagcctggccaacatggtgaaatgctgtctctactaaaagtacaaaaattagccaggcatggtggcatgcgccagtagtcccagctactcgggaggctgaggcagaagaattgcttgaacctgggaggtgaaggttgcagtgaacgaagatcacaccattgcactccagcttgggcaacacagcaagactccgtctcaaaaaaaaaaaaaaaatttacctagagtgtggcacatagcagggcctgtgaaccagatggaccttaccctggtgggcctgacttggtggggttgagtctctaagcatggcgttgaggcccagcacattccaaccctggactccctcagcctcctctcttcaccccacacccaaaagtttctcctctctcttgccttacccaaacttggtgccctatccttgcctaatcccctgcctaaggtccccctcctctctgtccgtccatcccatctgcatctttttttttttttgagatggagtctcgctctgtcccctaggctagagtgcaatggcgcgatcttggctcattgcaacctccgcctcctgggttcaagcgattctctgcctcagcctcccgagttgctgggattacaggcacacaacttcatgctcagctaatttttgtattttttagtagagacagggtttcaccatgttggccaggctggtctcgaactcctgccctcaggtggtccgcccaccttagcctcccaaagtgctgggattacaggcgtgagccaccgcgcctggcccccatttgcatcttaaaggtccatctcagatccatttccatttactgtcctagttctggtttggtccttggcaagtgcactttgccttgaacaaaatagtggcaaaagcttattgagcaggtactttgtgccagacactgctcagcatttcatggcattatctcatgaagccccacgacaattcctctgaagaagacacaggcaattctcattattcgcgatggttatgttctataaaatcacagtgaacattgaactagcaaacagtattaggttcctgtgagcctctggtcacaacattttcatcaaccaacagcatataatctggttttatgtatgattctgtttaaagacattttatttagtatatgtgttgctgattcatcaatgctaagctgatggcactatagcacacacctgaatcaagtgtctaacacacgctttctccctaaggtagccttcttgtgcttaggaactacacagctcttcagcaggaggctcagaggccatttccaaaagccaaatccccagcaaaagcacaaagtgtgaaaaacgttgcactaagtagactgagaaggacactcattcaataggagagctgaaacaagcagcagcagcgtgacgccttgttgaaccttaactgggaatgtgcaaatttttcactgctctgtgcatgcccacaaatggccatgaaaacatttcaagtattgacttgggagttacaaataaaattcagcaagtaggcacattctcaatgtagaaccagagaagaatgaggatcaactgtactattattactgccgttttacagataaggaaaccaaggctcagatcagagtggttaacagtgacttcaacattcaacaagtattattaagtgcctactttgtggcaagtgctcttcctggccttgggactgaagacttacccaaggtcacacagctagcaggttgtggagtcaggagtctactccagctatctgactcctgaacccaagtttttttttttttctttaagatggagtctcactctgtcacccaggctggagtgcagtggcgcgatctcggctcactgcaagctccgcctcccgggttcacaccattctcctgcctcggcctcccgagtagctgggactacaggcacctgccaccacccccagctaatttttttgtatttttagtagagagggggtttcactgtattagccaggatggtcttgatctcctgacctcgtgatctgcccgccttggcctcccaaagtgctgggattacaggcttgagccaccgcgcccggccctgaacccaacttttagagcagaaagtgttttcaatgcacagcgacctttttgagggtctgtccttttcctgaccagaccctgagggacagtgcctgagcagttgagtacaggggaagtcctcagagagtgtgttgtccctgcagttctcactgtcaccggggagccctgccacttccccttccagtaccaccggcagctgtaccacaaatgtacccacaagggccggccaggccctcagccctggtaagactacgcagaggagttggagcaggggcctgggagacatgtaccctgcctgtccttctgtccaaggaactctgcttggagagaggggactgtgatagggcagggtgggccaggcccctgggtagagcagggaagccttgtctctttctacaggtgtgctaccacccccaactttgatcaggaccagcgatggggatactgtttggagcccaagaaagtgaaaggtgctacacacagcctctggggtggcctggggctctctcctcccgcctcattactctcctggtatcaccagaccccacacacctgggattctggacccagccccttctctccctccacaataccctttggaagtccagagggagagttctgggaaggagtggtcccattttgcaggtgggtaaaccaagcttggaaacttggagtagcaaggtcacaaggcaagtaggttcaagaagggccttggcccccagctgtgtgactcagctccctgctcttccttccaccatgtccatctctcagaccactgcagcaaacacagcccctgccagaaaggagggacctgtgtgaacatgccaagcggcccccactgtctctgtccacaacacctcactggaaaccactgccagaaaggtgaggagatgtggaggacctgggcggggtgctgggggacaggggcaaccctgggcctacagaataggttgctggatactcggagacttggcatggtcctagactctcctgagaccactatccctctttgtccccagagaagtgctttgagcctcagcttctccggtttttccacaagaatgagatatggtatagaactgagcaagcagctgtggccagatgccagtgcaagggtcctgatgcccactgccagcggctggccagccagggtgagcagatggttgggaacgggccagggaggagcgtcaggaagacaggctggcaggaggccgggtggtgtgccaggaaggagagctctctgggggggtctttaggcccaggggtggctcactgcgttccctccccaagcctgccgcaccaacccgtgcctccatgggggtcgctgcctagaggtggagggccaccgcctgtgccactgcccggtgggctacaccggagccttctgcgacgtgggtgagtgagggtctggggcaagcagaaggccagcccccaggtgggacgggcttgccaggaaggaggagggagagtgcggaaagcagatgagagggaggcaggagagcccagccttggctgcccagggagccccctttctcctcagacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggtgcgccgcgtggggctgggtgacccctccgccccagggctccgggctcccggcgctctaacggcgccccgtcgtgtggctacaggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggaggttaggaagtgggggggggaaggaggagccgagagggcgccgggcgagctagattccggccagccggccgcgggctctccgtcctcagcccctgctcctccacagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcgagtacccgcccgcccagagccgccccaggggccgcggctcctccgtctcccagcgcagcttccacgctgcacccgaacccgtgccctaccttctcccgccccacccttctttccacgcccctccggagctcccggggaggaagctggaacacgggattggggttcgggagcagggggcttccccagaacgcttgtggccaggtctgagagcgctgcctctcccctaccccccccgcaggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctgggtgcgtgggggcgccccgcggggacgggaagagagcttggggccccggcgtccccgcctcacgctcctctccgcccgggttagctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggtaggcacaactgctaggggcaggggtaggggaggagacctttgatcactgggttaggcggaagaagcccgcgactttggtatcgttccgggtgcctacagaatgggtggcgctgacctgatgggttgtgagaatgtgtaggtgaatcccaggtagaatcccagggcctgggattcactgctgggatccccaaatctcctggggatacagggagaatcgaacttgctcttggttccctctgggcgccgggctgcaaaggccaactaggacgctggccccgcgctccgggctagtgtgggagccaggttctgcgactctggatgggtggtgggggaggggtttctgtttccgctccgcccattcaaatcctggcttttctctggacctcagcctccttgcctatgaaattgaattaatggcacctcctccccttcgggcttgctgcgagagaggaagggcatgagtgggtttacaagcgcctggagcagctttgtccatcgtccgggcggcaagcgttgtcagatggggtgtgaagaaggcgctctgtgttcgcaggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccaggtgagctcttagcccggttggcgcccttccccgaggccgtcaggcacaaatctcaggtccacagcgctgagctgcgtgtttccgacccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgag

SEQ ID NO: 3 - DNA, 14000 bp, Homo sapiens
ggaacagctgccttctccccaagaggaaggagccaatgtgggagtggccttagggccagggtctatactcaggagcaatcaagaactgacagagccaggcatgatggcatgaacctgtaatcccagctattcaggaggatgaagcgagaggatcacttgcgcccagaagttccaggctagcctgggcaacttaataagaccgagtctctttgaaacaacaaaaaaggtgacaaaggtagtttcgctttaatgactcgtcaatatatctaatagtttcactttcatcatggagttaacagctgtcacgtcaatgactttgaaaccagttacctttgaaaccagtggttggaaaggtgcccctcctctcctgccctcctctttctgtgtttctgttccaagaagtcttccacagcctgcctctcttccagcagaattaataaattgctacactcagtcttcatttcccataaattactttgtataacttaggactttgtataactgaaagtgacagaagtccactcaaattggttttattggctcatataactgagaagtctatttttttttttttttggagatacagtctcagtctgcttcccagactggagtgcagtggcacaatcacggctcacagcattttggacctctgggctcaagcaatcctcctgcctcagactcacaagtagccggaactacaggcacgcgccaccatgcctggctaatgttaaatttttttggagagatgggatctcactatgttgcctacatcagtctggaactcctgggctcaagtgatcctcaagtgatccccagcctcccagagtgttgggattacaggcgtgagccactgtgcctagccataactgaccaagtcttaaggatacttctagttttaggatgtaggctctcaaagtcatgagaaatcaatccatcagtactagttctcaaatgtcgtgtaacaaatcaccctaacttgtggcttaaagcaacaacatttaatgatgatttatcacagtttctgatggtcagttttgccttgaggtctttcataagattgcaagccaaatgtcagcgagggctgcagtatccacttccaaggcagcttattcatgtggctgtccaattggcactggctgtcagcagggtgctttcctttctccctacatgggcttctctgcagggctgcatgtgtgtcctcacaacacagtggctggcttcctccagagtgagcaacctaagagaccgaggcagaaactgcaatgtcttttatgacctgggcttggaagtccaacaccctcacttctgccatattttttttttttttgagacagtccctgtcgcccaggctggagtgcaatggcacaatctctgctcactacaacctccacttcctgggttcaagcgattctcctgcctcagcctcacgggtagctgggattacaggcacacgccactacgcccggctaatttttgtatttttcatagagatggggtttggccaacacgttggccaggccggtcttgaactcctgacctagagtgatctgcctgccttggcatcccaaagtgctgggattacaggtgtgagccaccacacccagccacttctgtcatattctgatggacacacagaacagccctaactcaatgtgggaagacaccatacaagggcatgaatcctaggtggtgaggatcaatgggggctgtctttgaggctgtctaccacagcatctttccatccttcctgccctgtttgctttgcttttcctatgtgtaggcttcattctcaaacaggccctccctagagagtgacaaaggtgatcatcaatgtgttcagacccacatgctctgtgcttagtaaccccagtgcaacttttttgctttcccaaaagttctggcaaaagtcccaagctagcactttaattggcctaaattgtgtatatgcttatctctgaaccaatcactgtggattagagatgtcatgctctgattgaccagacctaggccacatctctagccctagctctgagggtagagttggcagcactagagcccatggaagaagtaagagaggagtcgttgctaaaggaaaaatcaaagtgtcattaccgaaccaggacagatgctgggcagcacatgtgcaccccgtcttcttctcatgttccagctgcacatcttagtgccccttggtttagcacttttctcattaaatcatttgctttcttgcctcacttcctgtggttggtagaatgctaagatggccccaagatctctacccctggtgtttgcacacctcccagttattctgtcaaacatgaatgtagatgcttctgtgaaagaattttgcacatgtaatttaagtcccaaattgtttgaccttaaaataaggagaatggcagggccaggcatggtggctcatacctgtaatcccagcactttgggaggccaaggcgggcagatcacgaggtcaggagatcgagaccatcctggctaacacagtgaaaccccatctctactaaaaatacaaaaaattagctgggcgtggtggcgggtgcctgtattcccagctacccaggaggctgaggcaggagaatggcgtgaacccgggaggcgtagcttgcagtgagccaagatcgtgccactgcactccagcctgggtgacagagccagactctgtctcaaaaaaaaaaaaaaaaaggagaatggctttggtgggcctgacctagtcaggtgagttcttaaaaggcgacacatggcccggtgcagtggctcaggcctgtaatcccagcactttgggaggccgaggcgggtggatcacgaggtcaggagatcgagaccatcctggctaacatggtgaaaccccgtctctactaaaaagacaaaaaattagctgggcgtggtggtgggctcctgtagtcccagctactcgggaggctgaggcaggagaatggcgtgaacccgggaggcggagcttgcagtgagcggagattgcgccactgcactccagcctgggcgacagagcgagactccgtctcaaaaaaaaaaaaaaaaaaaagaaaattaaaagtgggtattgttgtaagatgctgagtttatggtagtttgttacatgacaatagaaaatgaacacacttcacagtggactccaagatccccatgatctttgatctccttaacctcctgatctccacaggacccagagcataagaatgtcccttcttctgcttccagtcccactatctagaaaagagaggaggagcccagctcttcatttcacccccacccacaaactcccaactttccggccctcaaggggtgaccaaggaagttgctccacttggctttccacaaacagcctgtgccccaccaggctcaggagggcagcttgaccaatctctatttccaagacctttggccagtcctattgatctggactcctggataggcagctggaccaacggacggatgccatgagggctctgctgctcctggggttcctgctggtgagcttggagtcaacactttcggtgagtgctgtgggaaccaggattgtcccaggattgttctggggggtcgctatcacagccatgagccatggcctctgctcatgacctgtgggtccaggtgactaggaggcctatgtggaaaggtgaggccagcccggaaggcccaggcagaggagacagacaaccagactgggtggatacaagggcacagcctgcatttctgggggagatgggccttaagaagacaacggggggaggtagaaagggtttgggtcttgggaagaaatctctgcatttctgggctgtgagaggaagctgcagactagcaacagatcggtggcaggctatgacttatagtcagttccctgccttcttctctcccttgtagattccaccttgggaagcccccaaggagcataagtacaaagctgaagagcacacagtcggtaagtggcctggctcctcctcccgggaacccttgggtggggatgtgtatggtgcagtgtgtgcagtctcagggcagtctagtctagtgcctacctggtgctaggtcttatgcccatgggcactagagtgatcgtgagctgtgtgatccttgagggcagggtatgggctgtgtctaagtgcccacgagcctggctcggagcaggtgcttgagatatgtgctgctggcgccatcacacctgggctcctgccagccttcctcagtttccccagcttctccccttcttttcctttccccagtacgtctcatgggcatcattcatgccacacagaggccagggccttcaatgggcaaggaaggatcaagagcttgtctctggcatctgaatgcctctgaagcccagctttatcacttatgagctgggtgactctgggcgagggatttgagttctccaagcttcaatttccccttctgtgaaaccaggttgataacagtaaacctcttagggttgttgagaagggaaacccatgtgaggtattcagcccatcacctggtgcatggaaatgctttacaaatattagcttttattatgaaactaccttttagatgaagggtacctgccatttcccccttcctcaagctctgccatagctccccattgctttcattcttccagacactaaattacctacatgccaggcatggtggctcatgcctgtaatcccagcactttgggaggccaaggtcggtggatcatgaggtcaggagttcgagaccagcctggccaacatggtgaaatgctgtctctactaaaagtacaaaaattagccaggcatggtggcatgcgccagtagtcccagctactcgggaggctgaggcagaagaattgcttgaacctgggaggtgaaggttgcagtgaacgaagatcacaccattgcactccagcttgggcaacacagcaagactccgtctcaaaaaaaaaaaaaaaatttacctagagtgtggcacatagcagggcctgtgaaccagatggaccttaccctggtgggcctgacttggtggggttgagtctctaagcatggcgttgaggcccagcacattccaaccctggactccctcagcctcctctcttcaccccacacccaaaagtttctcctctctcttgccttacccaaacttggtgccctatccttgcctaatcccctgcctaaggtccccctcctctctgtccgtccatcccatctgcatctttttttttttttgagatggagtctcgctctgtcccctaggctagagtgcaatggcgcgatcttggctcattgcaacctccgcctcctgggttcaagcgattctctgcctcagcctcccgagttgctgggattacaggcacacaacttcatgctcagctaatttttgtattttttagtagagacagggtttcaccatgttggccaggctggtctcgaactcctgccctcaggtggtccgcccaccttagcctcccaaagtgctgggattacaggcgtgagccaccgcgcctggcccccatttgcatcttaaaggtccatctcagatccatttccatttactgtcctagttctggtttggtccttggcaagtgcactttgccttgaacaaaatagtggcaaaagcttattgagcaggtactttgtgccagacactgctcagcatttcatggcattatctcatgaagccccacgacaattcctctgaagaagacacaggcaattctcattattcgcgatggttatgttctataaaatcacagtgaacattgaactagcaaacagtattaggttcctgtgagcctctggtcacaacattttcatcaaccaacagcatataatctggttttatgtatgattctgtttaaagacattttatttagtatatgtgttgctgattcatcaatgctaagctgatggcactatagcacacacctgaatcaagtgtctaacacacgctttctccctaaggtagccttcttgtgcttaggaactacacagctcttcagcaggaggctcagaggccatttccaaaagccaaatccccagcaaaagcacaaagtgtgaaaaacgttgcactaagtagactgagaaggacactcattcaataggagagctgaaacaagcagcagcagcgtgacgccttgttgaaccttaactgggaatgtgcaaatttttcactgctctgtgcatgcccacaaatggccatgaaaacatttcaagtattgacttgggagttacaaataaaattcagcaagtaggcacattctcaatgtagaaccagagaagaatgaggatcaactgtactattattactgccgttttacagataaggaaaccaaggctcagatcagagtggttaacagtgacttcaacattcaacaagtattattaagtgcctactttgtggcaagtgctcttcctggccttgggactgaagacttacccaaggtcacacagctagcaggttgtggagtcaggagtctactccagctatctgactcctgaacccaagtttttttttttttctttaagatggagtctcactctgtcacccaggctggagtgcagtggcgcgatctcggctcactgcaagctccgcctcccgggttcacaccattctcctgcctcggcctcccgagtagctgggactacaggcacctgccaccacccccagctaatttttttgtatttttagtagagagggggtttcactgtattagccaggatggtcttgatctcctgacctcgtgatctgcccgccttggcctcccaaagtgctgggattacaggcttgagccaccgcgcccggccctgaacccaacttttagagcagaaagtgttttcaatgcacagcgacctttttgagggtctgtccttttcctgaccagaccctgagggacagtgcctgagcagttgagtacaggggaagtcctcagagagtgtgttgtccctgcagttctcactgtcaccggggagccctgccacttccccttccagtaccaccggcagctgtaccacaaatgtacccacaagggccggccaggccctcagccctggtaagactacgcagaggagttggagcaggggcctgggagacatgtaccctgcctgtccttctgtccaaggaactctgcttggagagaggggactgtgatagggcagggtgggccaggcccctgggtagagcagggaagccttgtctctttctacaggtgtgctaccacccccaactttgatcaggaccagcgatggggatactgtttggagcccaagaaagtgaaaggtgctacacacagcctctggggtggcctggggctctctcctcccgcctcattactctcctggtatcaccagaccccacacacctgggattctggacccagccccttctctccctccacaataccctttggaagtccagagggagagttctgggaaggagtggtcccattttgcaggtgggtaaaccaagcttggaaacttggagtagcaaggtcacaaggcaagtaggttcaagaagggccttggcccccagctgtgtgactcagctccctgctcttccttccaccatgtccatctctcagaccactgcagcaaacacagcccctgccagaaaggagggacctgtgtgaacatgccaagcggcccccactgtctctgtccacaacacctcactggaaaccactgccagaaaggtgaggagatgtggaggacctgggcggggtgctgggggacaggggcaaccctgggcctacagaataggttgctggatactcggagacttggcatggtcctagactctcctgagaccactatccctctttgtccccagagaagtgctttgagcctcagcttctccggtttttccacaagaatgagatatggtatagaactgagcaagcagctgtggccagatgccagtgcaagggtcctgatgcccactgccagcggctggccagccagggtgagcagatggttgggaacgggccagggaggagcgtcaggaagacaggctggcaggaggccgggtggtgtgccaggaaggagagctctctgggggggtctttaggcccaggggtggctcactgcgttccctccccaagcctgccgcaccaacccgtgcctccatgggggtcgctgcctagaggtggagggccaccgcctgtgccactgcccggtgggctacaccggagccttctgcgacgtgggtgagtgagggtctggggcaagcagaaggccagcccccaggtgggacgggcttgccaggaaggaggagggagagtgcggaaagcagatgagagggaggcaggagagcccagccttggctgcccagggagccccctttctcctcagacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggtgcgccgcgtggggctgggtgacccctccgccccagggctccgggctcccggcgctctaacggcgccccgtcgtgtggctacaggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggaggttaggaagtgggggggggaaggaggagccgagagggcgccgggcgagctagattccggccagccggccgcgggctctccgtcctcagcccctgctcctccacagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcgagtacccgcccgcccagagccgccccaggggccgcggctcctccgtctcccagcgcagcttccacgctgcacccgaacccgtgccctaccttctcccgccccacccttctttccacgcccctccggagctcccggggaggaagctggaacacgggattggggttcgggagcagggggcttccccagaacgcttgtggccaggtctgagagcgctgcctctcccctaccccccccgcaggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctgggtgcgtgggggcgccccgcggggacgggaagagagcttggggccccggcgtccccgcctcacgctcctctccgcccgggttagctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggtaggcacaactgctaggggcaggggtaggggaggagacctttgatcactgggttaggcggaagaagcccgcgactttggtatcgttccgggtgcctacagaatgggtggcgctgacctgatgggttgtgagaatgtgtaggtgaatcccaggtagaatcccagggcctgggattcactgctgggatccccaaatctcctggggatacagggagaatcgaacttgctcttggttccctctgggcgccgggctgcaaaggccaactaggacgctggccccgcgctccgggctagtgtgggagccaggttctgcgactctggatgggtggtgggggaggggtttctgtttccgctccgcccattcaaatcctggcttttctctggacctcagcctccttgcctatgaaattgaattaatggcacctcctccccttcgggcttgctgcgagagaggaagggcatgagtgggtttacaagcgcctggagcagctttgtccatcgtccgggcggcaagcgttgtcagatggggtgtgaagaaggcgctctgtgttcgcaggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccaggtgagctcttagcccggttggcgcccttccccgaggccgtcaggcacaaatctcaggtccacagcgctgagctgcgtgtttccgacccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgagaaggaaagctcttttcttcatgggtcccgccgggaaatgccaagacagaaaagcgattcacagcttctccacagctctcagagaacaaggtctatgagatcttaacgtgcaaaatctagatgccagcccagctaatgtttactgagcctaggatactgtataccaagccctgtgcaaggagaagctgcatgttattccttatgagaaactaacattttgtttacagagcagtagttctcagaccatacattaagatcacttggggagcgttttgagccaatctatgcccaagttccacctcagaccaattaaatcagtatgtctagggatggggcatgggtagtggtatatttgtaaaactccccagataattccatgtacagccaaggttgagaatcgtggttagaaatacttagcattggccgggcgcggtggctcacgcctgtaatcctagcactttaagaggccaaggcaggtggattgctcaggagttcgaaaccagcctgggcaacacgatgaaaccccgtctctactaaaatacaagaaattagccgggcacggcggcgtgcgcctgtagtcccagctactcaggaggctgaggcaggagaatcacttgaaccggcaggaaggaaggaaggaaggaacagagggagggaaagagagagacagaaagaaaagaaaaaagaaaatagaaaaaaagagcattgactgtggcgtggaccctaagggctgggtgacatatcgttgtccccaccccaacacgcactagtgtagtgggtctgagagtcccttggctagcagtaccatcaccagggaacttgttacacataacaaattctcgggctacactttatactgctgaacagaaagtctggggtggggcccagcaatctgtttaacagccttgcgggggattctgatgttctctcatgcttaagaaccacaatctgggggttgaatggttggttcccttacaagtgaaggtctggctgtccagacacaacatccttttttcacaaaaccagctttttaaaattaaaaatagattggccagatgcggtggttcacgcctgtaatctcgtcactttgagaggctgaggcgggaggattgtttgagctcaagacttcctgacccgcctgggcaacatagtgagacctcatctcaaaaaaattttttttaattaaaatttgtttttgcttttttagagacggggcctcgctctgtggctcaggctggcgtgcagcgacacgatcctataatagtttactataatctcgctactgagttcaagcgatccgcccgcctcggcctcccaaagcgctgggattacaggagtgagccgctgcgctctgccaaacccatcctacaggataaccttagaactgcgacagcactaaacgcccacgccccacgtgccccagcctgggtggtcgctccgggacggcgccttgtgtgacgtcacagccccgcccagcctgcctcacagcgccgcaggccttccccgcgtggcgcctctatatttccccgagaggtgcgaggcggctgggcgcactcggagcgcgatgggcgactggaaggtctacatcagtgcagtgctgcgggaccagcgcatcgacgacgtggccatcgtgggccatgcggacaacagctgcgtgtgggcttcgcggcccgggggcctgctggcggccatctcgccgcaggaggtgggcgtgctcacggggccggacaggcacaccttcctgcaggcgggcctgagcgtggggggccgccgctgctgcgtcatccgcgaccacctgctggccgagggtgacggcgtgctggacgcacgcaccaaggggctggacgcgcgcgccgtgtgcgtgggccgtgcgccgcgcgcgctcctggtgctaatgggccgacgcggcgtacatgggggcatcctcaacaagacggtgcacgaactcatacgcgggctgcgcatgcagggcgcctagccggccagccaggccgcccactggtagcgcgggccaaataaactgtgacctgggcgcggctggctcctcctccacttgcgcggtggggggagttgtaaataaggaaactggtctttgcaagacggttacctggtggagccgggattttgagtctagaggctgccaggcccctgtgccctacaccctgctctcccatggacgccttgcagaggctcctggcctgactgctgctccttggcgcgttcccagggtcctagggactccgcagctgaggaagagtccaagggtgggggcttctcaaagtctgtttcagccttagcgtcctttctcagagatattcccacacattaggcaggacaagtaaagggagccccctccccatcccgcgaacacctctccccatcagggtgtcaggctggaggccaatttgctcctcccccctccactcatacctcaagcactagcaagttgtgagtgggtgacaggatgggcttggtggcttgtaaagcagttctggggctcacaggcctctgcatctctgcccacattcctccaaggggagcctactgagagggctcatgtccaagaccatcgcaattgggtttgagaccttacatcctgccttccccaggccttcgaaaaggccccgcaggagtccctggactagagggaggaactctggcatccctacccgggagtctcactctgcaggcctcagtttcagggtgacctatggaggagggggaattgaaaagcttgggtaagtttgaggcctggtttattgcccaaagatagtggacaaaagtgggagggagggtgtctggtccctgccctccatgtgctggggcccagggcatggcctctcttgcccacccccacccttcccgtcccctcccccagcggccctgatggcagaccccacctgtcacttattctggagccctgatcttatcccagcaggaaggagtgatgtgtggctgaggtgggtgaatttagagggcagagggagaccagaggaagttcagccaggtgggggtcagggggtgggggtgcagaatcctccttacacttgccttgggggtggccccaggcctaggaggggcttccagggagtttgaattgtggtttggactcactaaggtagggccaggcagatggttgg

SEQ ID NO: 4 - DNA, 2060 bp, Homo sapiens
ctattgatctggactcctggataggcagctggaccaacggacggatgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggagccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgagaaaaaaaaaaa

SEQ ID NO: 5 - DNA, 23 bp, Artificial sequence
  Primer
gtcaacactttcgattccacctt

SEQ ID NO: 6 - DNA, 20 bp, Artificial sequence
  Primer
tccccggtgacagtgagaac

SEQ ID NO: 7 - DNA, 30 bp, Artificial sequence
  Probe
aagcccccaaggagcataagtacaaagctg

SEQ ID NO: 8 - DNA, 18 bp, Artificial sequence
  Primer
gtgcacggatcctccatc

SEQ ID NO: 9 - DNA, 19 bp, Artificial sequence
  Primer
cagcttggtcctcacacac

SEQ ID NO: 10 - DNA, 20 bp, Artificial sequence
  Probe
aatcaccctggcacgcatcg

SEQ ID NO: 11 - DNA, 17 bp, Artificial sequence
  Primer
ccgggagcacaccgttt

SEQ ID NO: 12 - DNA, 21 bp, Artificial sequence
  Primer
ggaatcaccaaggagggaaag

SEQ ID NO: 13 - DNA, 17 bp, Artificial sequence
  Probe
ctgattgctcagggact

SEQ ID NO: 14-19 - skipped (6 entries)

SEQ ID NO: 20 - DNA, 20 bp, Artificial sequence
  Synthetic oligonucleotide
ccaggagtccagatcaatag

SEQ ID NO: 21 - DNA, 20 bp, Artificial sequence
  Synthetic oligonucleotide
tcaccagcaggaaccccagg

SEQ ID NO: 22 - DNA, 20 bp, Artificial sequence
  Synthetic oligonucleotide
ggaatcgaaagtgttgactc

SEQ ID NO: 23 - DNA, 20 bp, Artificial sequence
  Synthetic oligonucleotide
ggtgacagtgagaacgactg

SEQ ID NO: 24 - DNA, 20 bp, Artificial sequence
  Synthetic oligonucleotide
tccccggtgacagtgagaac

SEQ ID NO: 25 - DNA, 20 bp, Artificial sequence
  Synthetic oligonucleotide
gggtacatttgtggtacagc

SEQ ID NO: 26 - DNA, 20 bp, Artificial sequence
  Synthetic oligonucleotide
cggcccttgtgggtacattt

SEQ ID NO: 27 - DNA, 20 bp, Artificial sequence
  Synthetic oligonucleotide
agggcctggccggcccttgt

SEQ ID NO: 28 - DNA, 20 bp, Artificial sequence
  Synthetic oligonucleotide
gtatccccatcgctggtcct

SEQ ID NO: 29 - DNA, 20 bp, Artificial sequence
  Synthetic oligonucleotide
tgcagtggtctttcactttc

SEQ ID NO: 30 - DNA, 20 bp, Artificial sequence
  Synthetic oligonucleotide
ttgtggacagagacagtggg

SEQ ID NO: 31 - DNA, 20 bp, Artificial sequence
  Synthetic oligonucleotide
cagtgaggtgttgtggacag

SEQ ID NO: 32 - DNA, 20 bp, Artificial sequence
  Synthetic oligonucleotide
agaagctgaggctcaaagca

SEQ ID NO: 33 - DNA, 20 bp, Artificial sequence
  Synthetic oligonucleotide
gaaaaaccggagaagctgag

SEQ ID NO: 34 - DNA, 20 bp, Artificial sequence
  Synthetic oligonucleotide
tggcatctggccacagctgc

SEQ ID NO: 35 - DNA, 20 bp, Artificial sequence
  Synthetic oligonucleotide
tgcactggcatctggccaca

SEQ ID NO: 36 - DNA, 20 bp, Artificial sequence
  Synthetic oligonucleotide
aggacccttgcactggcatc

SEQ ID NO: 37 - DNA, 20 bp, Artificial sequence
  Synthetic oligonucleotide
agtgggcatcaggacccttg

SEQ ID NO: 38 - DNA, 20 bp, Artificial sequence
  Synthetic oligonucleotide
agccgctggcagtgggcatc

SEQ ID NO: 39 - DNA, 20 bp, Artificial sequence
  Synthetic oligonucleotide
aggcctggctggccagccgc

SEQ ID NO: 40 - DNA, 20 bp, Artificial sequence
  Synthetic oligonucleotide
gcggcaggcctggctggcca

SEQ ID NO: 41 - DNA, 20 bp, Artificial sequence
  Synthetic oligonucleotide
ttggtgcggcaggcctggct

SEQ ID NO: 42 - DNA, 20 bp, Artificial sequence
  Synthetic oligonucleotide
ccatggaggcacgggttggt

SEQ ID NO: 43 - DNA, 20 bp, Artificial sequence
  Synthetic oligonucleotide
tccacctctaggcagcgacc

SEQ ID NO: 44 - DNA, 20 bp, Artificial sequence
  Synthetic oligonucleotide
tggcacaggcggtggccctc

SEQ ID NO: 45 - DNA, 20 bp, Artificial sequence
  Synthetic oligonucleotide
ccgcggccatcatagcagct

SEQ ID NO: 46 - DNA, 20 bp, Artificial sequence
  Synthetic oligonucleotide
tgagcccgcggccatcatag

SEQ ID NO: 47 - DNA, 20 bp, Artificial sequence
  Synthetic oligonucleotide
gtagctgagcccgcggccat

SEQ ID NO: 48 - DNA, 20 bp, Artificial sequence
  Synthetic oligonucleotide
aggccgcggtagctgagccc

SEQ ID NO: 49 - DNA, 20 bp, Artificial sequence
  Synthetic oligonucleotide
tggccaggccgcggtagctg

SEQ ID NO: 50 - DNA, 20 bp, Artificial sequence
  Synthetic oligonucleotide
ggtcctggccaggccgcggt

SEQ ID NO: 51 - DNA, 20 bp, Artificial sequence
  Synthetic oligonucleotide
tgacagggcgcacccgagag

SEQ ID NO: 52 - DNA, 20 bp, Artificial sequence
  Synthetic oligonucleotide
acggctgacagggcgcaccc

SEQ ID NO: 53 - DNA, 20 bp, Artificial sequence
  Synthetic oligonucleotide
gtccccagttccgcgcttgc

SEQ ID NO: 54 - DNA, 20 bp, Artificial sequence
  Synthetic oligonucleotide
tggccgcccagtccccagtt

SEQ ID NO: 55 - DNA, 20 bp, Artificial sequence
  Synthetic oligonucleotide
tccgggttccggcagaaggc

SEQ ID NO: 56 - DNA, 20 bp, Artificial sequence
  Synthetic oligonucleotide
aagcaccacgggcggatgtc

SEQ ID NO: 57 - DNA, 20 bp, Artificial sequence
  Synthetic oligonucleotide
tcagcacgaagcaccacggg

SEQ ID NO: 58 - DNA, 20 bp, Artificial sequence
  Synthetic oligonucleotide
catgagtgggacatgaagcc

SEQ ID NO: 59 - DNA, 20 bp, Artificial sequence
  Synthetic oligonucleotide
gagccgctgcccgcagctca

SEQ ID NO: 60 - DNA, 20 bp, Artificial sequence
  Synthetic oligonucleotide
acagactcttgcggagccgc

SEQ ID NO: 61 - DNA, 20 bp, Artificial sequence
  Synthetic oligonucleotide
cgaagacagactcttgcgga

SEQ ID NO: 62 - DNA, 20 bp, Artificial sequence
  Synthetic oligonucleotide
gtcatcgaagacagactctt

SEQ ID NO: 63 - DNA, 20 bp, Artificial sequence
  Synthetic oligonucleotide
tggccccagtacagcgcggc

SEQ ID NO: 64 - DNA, 20 bp, Artificial sequence
  Synthetic oligonucleotide
ggctgccggcgcagaaactg

SEQ ID NO: 65 - DNA, 20 bp, Artificial sequence
  Synthetic oligonucleotide
gatgaggctgccggcgcaga

SEQ ID NO: 66 - DNA, 20 bp, Artificial sequence
  Synthetic oligonucleotide
ggccggtcctgcaggcagtg

SEQ ID NO: 67 - DNA, 20 bp, Artificial sequence
  Synthetic oligonucleotide
accgtcagatcctcgggtgc

SEQ ID NO: 68 - DNA, 20 bp, Artificial sequence
  Synthetic oligonucleotide
tgcaagcggtaggagcgcac

SEQ ID NO: 69 - DNA, 20 bp, Artificial sequence
  Synthetic oligonucleotide
ggcgcaacagagccaggtcg

SEQ ID NO: 70 - DNA, 20 bp, Artificial sequence
  Synthetic oligonucleotide
gcagctgccgtccgcatcct

SEQ ID NO: 71 - DNA, 20 bp, Artificial sequence
  Synthetic oligonucleotide
gacaggagcgcgcagctgcc

SEQ ID NO: 72 - DNA, 20 bp, Artificial sequence
  Synthetic oligonucleotide
gcaggcacaccggctgaacg

SEQ ID NO: 73 - DNA, 20 bp, Artificial sequence
  Synthetic oligonucleotide
gcgccgcttggcaggcacac

SEQ ID NO: 74 - DNA, 20 bp, Artificial sequence
  Synthetic oligonucleotide
tcgaactggtggccccagcc

SEQ ID NO: 75 - DNA, 20 bp, Artificial sequence
  Synthetic oligonucleotide
cctgcgcagagcatgccggg

SEQ ID NO: 76 - DNA, 20 bp, Artificial sequence
  Synthetic oligonucleotide
ggaaccctgcgcagagcatg

SEQ ID NO: 77 - DNA, 20 bp, Artificial sequence
  Synthetic oligonucleotide
ctcgaggaaccctgcgcaga

SEQ ID NO: 78 - DNA, 20 bp, Artificial sequence
  Synthetic oligonucleotide
gccgccctcgaggaaccctg

SEQ ID NO: 79 - DNA, 20 bp, Artificial sequence
  Synthetic oligonucleotide
gtcctcacacaccagcgggc

SEQ ID NO: 80 - DNA, 20 bp, Artificial sequence
  Synthetic oligonucleotide
gcttggtcctcacacaccag

SEQ ID NO: 81 - DNA, 20 bp, Artificial sequence
  Synthetic oligonucleotide
cttgcagggtgagccggcgc

SEQ ID NO: 82 - DNA, 20 bp, Artificial sequence
  Synthetic oligonucleotide
gatgccttgcagggtgagcc

SEQ ID NO: 83 - DNA, 20 bp, Artificial sequence
  Synthetic oligonucleotide
gcggtcaccacagcccgatc

SEQ ID NO: 84 - DNA, 20 bp, Artificial sequence
  Synthetic oligonucleotide
ttgttgcggtcaccacagcc

SEQ ID NO: 85 - DNA, 20 bp, Artificial sequence
  Synthetic oligonucleotide
cctggcttgttgcggtcacc

SEQ ID NO: 86 - DNA, 20 bp, Artificial sequence
  Synthetic oligonucleotide
ggccacatcggtgtagacgc

SEQ ID NO: 87 - DNA, 20 bp, Artificial sequence
  Synthetic oligonucleotide
tagtaggccacatcggtgta

SEQ ID NO: 88 - DNA, 20 bp, Artificial sequence
  Synthetic oligonucleotide
ccaggtagtaggccacatcg

SEQ ID NO: 89 - DNA, 20 bp, Artificial sequence
  Synthetic oligonucleotide
ccaggccaggtagtaggcca

SEQ ID NO: 90 - DNA, 20 bp, Artificial sequence
  Synthetic oligonucleotide
cggatccaggccaggtagta

SEQ ID NO: 91 - DNA, 20 bp, Artificial sequence
  Synthetic oligonucleotide
agtccctgagcaatcaggaa

SEQ ID NO: 92 - DNA, 20 bp, Artificial sequence
  Synthetic oligonucleotide
gggaaagatgagtccctgag

SEQ ID NO: 93 - DNA, 20 bp, Artificial sequence
  Synthetic oligonucleotide
atcctggcgcggagctggcc

SEQ ID NO: 94 - DNA, 20 bp, Artificial sequence
  Synthetic oligonucleotide
ttcctgcgccatcctggcgc

SEQ ID NO: 95 - DNA, 20 bp, Artificial sequence
  Synthetic oligonucleotide
ctttattgagttcctgcgcc

SEQ ID NO: 96 - DNA, 20 bp, Artificial sequence
  Synthetic oligonucleotide
tttcaaagcactttattgag

SEQ ID NO: 97 - DNA, 20 bp, Artificial sequence
  Synthetic oligonucleotide
agcattttcaaagcacttta

SEQ ID NO: 98 - DNA, 20 bp, Artificial sequence
  Synthetic oligonucleotide
actcttgcggagccgctgcc

SEQ ID NO: 99 - DNA, 20 bp, Artificial sequence
  Synthetic oligonucleotide
cgggtcatcgaagacagact

SEQ ID NO: 100 - DNA, 20 bp, Artificial sequence
  Synthetic oligonucleotide
acgcgggtcatcgaagacag

SEQ ID NO: 101 - DNA, 20 bp, Artificial sequence
  Synthetic oligonucleotide
acgacgcgggtcatcgaaga

SEQ ID NO: 102 - DNA, 20 bp, Artificial sequence
  Synthetic oligonucleotide
ccaacgacgcgggtcatcga

SEQ ID NO: 103 - DNA, 20 bp, Artificial sequence
  Synthetic oligonucleotide
ccgccaacgacgcgggtcat

SEQ ID NO: 104 - DNA, 20 bp, Artificial sequence
  Synthetic oligonucleotide
agcccgccaacgacgcgggt

SEQ ID NO: 105 - DNA, 20 bp, Artificial sequence
  Synthetic oligonucleotide
accagcccgccaacgacgcg

SEQ ID NO: 106 - DNA, 20 bp, Artificial sequence
  Synthetic oligonucleotide
gccaccagcccgccaacgac

SEQ ID NO: 107 - DNA, 20 bp, Artificial sequence
  Synthetic oligonucleotide
tacagcgcggcgatgtaggg

SEQ ID NO: 108 - DNA, 20 bp, Artificial sequence
  Synthetic oligonucleotide
cagtacagcgcggcgatgta

SEQ ID NO: 109 - DNA, 20 bp, Artificial sequence
  Synthetic oligonucleotide
ccccagtacagcgcggcgat

SEQ ID NO: 110 - DNA, 20 bp, Artificial sequence
  Synthetic oligonucleotide
ctgtggccccagtacagcgc

SEQ ID NO: 111 - DNA, 20 bp, Artificial sequence
  Synthetic oligonucleotide
aaactgtggccccagtacag

SEQ ID NO: 112 - DNA, 20 bp, Artificial sequence
  Synthetic oligonucleotide
gcgcagaaactgtggcccca

SEQ ID NO: 113 - DNA, 20 bp, Artificial sequence
  Synthetic oligonucleotide
ccggcgcagaaactgtggcc

SEQ ID NO: 114 - DNA, 20 bp, Artificial sequence
  Synthetic oligonucleotide
ggcgatgaggctgccggcgc

SEQ ID NO: 115 - DNA, 20 bp, Artificial sequence
  Synthetic oligonucleotide
gcggtaggagcgcacggcca

SEQ ID NO: 116 - DNA, 20 bp, Artificial sequence
  Synthetic oligonucleotide
gaaggcgcaacagagccagg

SEQ ID NO: 117 - DNA, 20 bp, Artificial sequence
  Synthetic oligonucleotide
cctgaaggcgcaacagagcc

SEQ ID NO: 118 - DNA, 20 bp, Artificial sequence
  Synthetic oligonucleotide
cctcctgaaggcgcaacaga

SEQ ID NO: 119 - DNA, 20 bp, Artificial sequence
  Synthetic oligonucleotide
ccgcatcctcctgaaggcgc

SEQ ID NO: 120 - DNA, 20 bp, Artificial sequence
  Synthetic oligonucleotide
cgtccgcatcctcctgaagg

SEQ ID NO: 121 - DNA, 20 bp, Artificial sequence
  Synthetic oligonucleotide
tgccgtccgcatcctcctga

SEQ ID NO: 122 - DNA, 20 bp, Artificial sequence
  Synthetic oligonucleotide
agctgccgtccgcatcctcc

SEQ ID NO: 123 - DNA, 20 bp, Artificial sequence
  Synthetic oligonucleotide
cagctgccgtccgcatcctc

SEQ ID NO: 124 - DNA, 20 bp, Artificial sequence
  Synthetic oligonucleotide
cgcagctgccgtccgcatcc

SEQ ID NO: 125 - DNA, 20 bp, Artificial sequence
  Synthetic oligonucleotide
gcgcagctgccgtccgcatc

SEQ ID NO: 126 - DNA, 20 bp, Artificial sequence
  Synthetic oligonucleotide
cgcgcagctgccgtccgcat

SEQ ID NO: 127 - DNA, 20 bp, Artificial sequence
  Synthetic oligonucleotide
gagcgcgcagctgccgtccg

SEQ ID NO: 128 - DNA, 20 bp, Artificial sequence
  Synthetic oligonucleotide
ggcgacaggagcgcgcagct

SEQ ID NO: 129 - DNA, 20 bp, Artificial sequence
  Synthetic oligonucleotide
taaggcgacaggagcgcgca

SEQ ID NO: 130 - DNA, 20 bp, Artificial sequence
  Synthetic oligonucleotide
ttggcaggcacaccggctga

SEQ ID NO: 131 - DNA, 20 bp, Artificial sequence
  Synthetic oligonucleotide
cgcttggcaggcacaccggc

SEQ ID NO: 132 - DNA, 20 bp, Artificial sequence
  Synthetic oligonucleotide
ctcggagggtcgcgcggcgc

SEQ ID NO: 133 - DNA, 20 bp, Artificial sequence
  Synthetic oligonucleotide
ccctcgaactggtggcccca

SEQ ID NO: 134 - DNA, 20 bp, Artificial sequence
  Synthetic oligonucleotide
cgcctcctgcaggaagctgg

SEQ ID NO: 135 - DNA, 20 bp, Artificial sequence
  Synthetic oligonucleotide
ctgcgcctcctgcaggaagc

SEQ ID NO: 136 - DNA, 20 bp, Artificial sequence
  Synthetic oligonucleotide
tacctgcgcctcctgcagga

SEQ ID NO: 137 - DNA, 20 bp, Artificial sequence
  Synthetic oligonucleotide
aaccctgcgcagagcatgcc

SEQ ID NO: 138 - DNA, 20 bp, Artificial sequence
  Synthetic oligonucleotide
aggaaccctgcgcagagcat

SEQ ID NO: 139 - DNA, 20 bp, Artificial sequence
  Synthetic oligonucleotide
gaggaaccctgcgcagagca

SEQ ID NO: 140 - DNA, 20 bp, Artificial sequence
  Synthetic oligonucleotide
gccctcgaggaaccctgcgc

SEQ ID NO: 141 - DNA, 20 bp, Artificial sequence
  Synthetic oligonucleotide
cgccctcgaggaaccctgcg

SEQ ID NO: 142 - DNA, 20 bp, Artificial sequence
  Synthetic oligonucleotide
gtgccgccctcgaggaaccc

SEQ ID NO: 143 - DNA, 20 bp, Artificial sequence
  Synthetic oligonucleotide
ggtgccgccctcgaggaacc

SEQ ID NO: 144 - DNA, 20 bp, Artificial sequence
  Synthetic oligonucleotide
catcggtgccgccctcgagg

SEQ ID NO: 145 - DNA, 20 bp, Artificial sequence
  Synthetic oligonucleotide
aggccacatcggtgtagacg

SEQ ID NO: 146 - DNA, 20 bp, Artificial sequence
  Synthetic oligonucleotide
taggccacatcggtgtagac

SEQ ID NO: 147 - DNA, 20 bp, Artificial sequence
  Synthetic oligonucleotide
tccctgagcaatcaggaaac

SEQ ID NO: 148 - DNA, 20 bp, Artificial sequence
  Synthetic oligonucleotide
gtccctgagcaatcaggaaa

SEQ ID NO: 149 - DNA, 20 bp, Artificial sequence
  Synthetic oligonucleotide
gagtccctgagcaatcagga

SEQ ID NO: 150 - DNA, 20 bp, Artificial sequence
  Synthetic oligonucleotide
tgagtccctgagcaatcagg

SEQ ID NO: 151 - DNA, 20 bp, Artificial sequence
  Synthetic oligonucleotide
gaaagatgagtccctgagca

SEQ ID NO: 152 - DNA, 20 bp, Artificial sequence
  Synthetic oligonucleotide
ggaaagatgagtccctgagc

SEQ ID NO: 153 - DNA, 20 bp, Artificial sequence
  Synthetic oligonucleotide
agggaaagatgagtccctga

SEQ ID NO: 154 - DNA, 20 bp, Artificial sequence
  Synthetic oligonucleotide
gagggaaagatgagtccctg

SEQ ID NO: 155 - DNA, 20 bp, Artificial sequence
  Synthetic oligonucleotide
ggagggaaagatgagtccct

SEQ ID NO: 156 - DNA, 20 bp, Artificial sequence
  Synthetic oligonucleotide
tgccttccatgccccagcca

SEQ ID NO: 157 - DNA, 20 bp, Artificial sequence
  Synthetic oligonucleotide
gccatcctggcgcggagctg

SEQ ID NO: 158 - DNA, 20 bp, Artificial sequence
  Synthetic oligonucleotide
tgcgccatcctggcgcggag

SEQ ID NO: 159 - DNA, 20 bp, Artificial sequence
  Synthetic oligonucleotide
gagttcctgcgccatcctgg

SEQ ID NO: 160 - DNA, 20 bp, Artificial sequence
  Synthetic oligonucleotide
attgagttcctgcgccatcc

SEQ ID NO: 161 - DNA, 20 bp, Artificial sequence
  Synthetic oligonucleotide
tttattgagttcctgcgcca

SEQ ID NO: 162 - DNA, 20 bp, Artificial sequence
  Synthetic oligonucleotide
actttattgagttcctgcgc

SEQ ID NO: 163 - DNA, 20 bp, Artificial sequence
  Synthetic oligonucleotide
cactttattgagttcctgcg

SEQ ID NO: 164 - DNA, 20 bp, Artificial sequence
  Synthetic oligonucleotide
gcactttattgagttcctgc

SEQ ID NO: 165 - DNA, 20 bp, Artificial sequence
  Synthetic oligonucleotide
aaagcactttattgagttcc

SEQ ID NO: 166 - DNA, 20 bp, Artificial sequence
  Synthetic oligonucleotide
ctcagcattttcaaagcact

SEQ ID NO: 167 - DNA, 20 bp, Artificial sequence
  Synthetic oligonucleotide
accccaggagcagcagagcc

SEQ ID NO: 168 - DNA, 20 bp, Artificial sequence
  Synthetic oligonucleotide
ggaaccccaggagcagcaga

SEQ ID NO: 169 - DNA, 20 bp, Artificial sequence
  Synthetic oligonucleotide
gcaggaaccccaggagcagc

SEQ ID NO: 170 - DNA, 20 bp, Artificial sequence
  Synthetic oligonucleotide
ccagcaggaaccccaggagc

SEQ ID NO: 171 - DNA, 20 bp, Artificial sequence
  Synthetic oligonucleotide
ggtggaatcgaaagtgttga

SEQ ID NO: 172 - DNA, 20 bp, Artificial sequence
  Synthetic oligonucleotide
caaggtggaatcgaaagtgt

SEQ ID NO: 173 - DNA, 20 bp, Artificial sequence
  Synthetic oligonucleotide
tgctcttcagctttgtactt

SEQ ID NO: 174 - DNA, 20 bp, Artificial sequence
  Synthetic oligonucleotide
gtgtgctcttcagctttgta

SEQ ID NO: 175 - DNA, 20 bp, Artificial sequence
  Synthetic oligonucleotide
actgtgtgctcttcagcttt

SEQ ID NO: 176 - DNA, 20 bp, Artificial sequence
  Synthetic oligonucleotide
acgactgtgtgctcttcagc

SEQ ID NO: 177 - DNA, 20 bp, Artificial sequence
  Synthetic oligonucleotide
acagtgagaacgactgtgtg

SEQ ID NO: 178 - DNA, 20 bp, Artificial sequence
  Synthetic oligonucleotide
ggctccccggtgacagtgag

SEQ ID NO: 179 - DNA, 20 bp, Artificial sequence
  Synthetic oligonucleotide
cagggctccccggtgacagt

SEQ ID NO: 180 - DNA, 20 bp, Artificial sequence
  Synthetic oligonucleotide
tggcagggctccccggtgac

SEQ ID NO: 181 - DNA, 20 bp, Artificial sequence
  Synthetic oligonucleotide
aagtggcagggctccccggt

SEQ ID NO: 182 - DNA, 20 bp, Artificial sequence
  Synthetic oligonucleotide
gtacatttgtggtacagctg

SEQ ID NO: 183 - DNA, 20 bp, Artificial sequence
  Synthetic oligonucleotide
ggtacatttgtggtacagct

SEQ ID NO: 184 - DNA, 20 bp, Artificial sequence
  Synthetic oligonucleotide
gtgggtacatttgtggtaca

SEQ ID NO: 185 - DNA, 20 bp, Artificial sequence
  Synthetic oligonucleotide
ccttgtgggtacatttgtgg

SEQ ID NO: 186 - DNA, 20 bp, Artificial sequence
  Synthetic oligonucleotide
ggccggcccttgtgggtaca

SEQ ID NO: 187 - DNA, 20 bp, Artificial sequence
  Synthetic oligonucleotide
tttcactttcttgggctcca

SEQ ID NO: 188 - DNA, 20 bp, Artificial sequence
  Synthetic oligonucleotide
gtctttcactttcttgggct

SEQ ID NO: 189 - DNA, 20 bp, Artificial sequence
  Synthetic oligonucleotide
gtggtctttcactttcttgg

SEQ ID NO: 190 - DNA, 20 bp, Artificial sequence
  Synthetic oligonucleotide
gctgaggctcaaagcacttc

SEQ ID NO: 191 - DNA, 20 bp, Artificial sequence
  Synthetic oligonucleotide
cggagaagctgaggctcaaa

SEQ ID NO: 192 - DNA, 20 bp, Artificial sequence
  Synthetic oligonucleotide
aaccggagaagctgaggctc

SEQ ID NO: 193 - DNA, 20 bp, Artificial sequence
  Synthetic oligonucleotide
gtggaaaaaccggagaagct

SEQ ID NO: 194 - DNA, 20 bp, Artificial sequence
  Synthetic oligonucleotide
tctataccatatctcattct

SEQ ID NO: 195 - DNA, 20 bp, Artificial sequence
  Synthetic oligonucleotide
ggccacagctgcttgctcag

SEQ ID NO: 196 - DNA, 20 bp, Artificial sequence
  Synthetic oligonucleotide
cactggcatctggccacagc

SEQ ID NO: 197 - DNA, 20 bp, Artificial sequence
  Synthetic oligonucleotide
gcactggcatctggccacag

SEQ ID NO: 198 - DNA, 20 bp, Artificial sequence
  Synthetic oligonucleotide
ttgcactggcatctggccac

SEQ ID NO: 199 - DNA, 20 bp, Artificial sequence
  Synthetic oligonucleotide
cttgcactggcatctggcca

SEQ ID NO: 200 - DNA, 20 bp, Artificial sequence
  Synthetic oligonucleotide
ccttgcactggcatctggcc

SEQ ID NO: 201 - DNA, 20 bp, Artificial sequence
  Synthetic oligonucleotide
ggcatcaggacccttgcact

SEQ ID NO: 202 - DNA, 20 bp, Artificial sequence
  Synthetic oligonucleotide
ggcagtgggcatcaggaccc

SEQ ID NO: 203 - DNA, 20 bp, Artificial sequence
  Synthetic oligonucleotide
gctggcagtgggcatcagga

SEQ ID NO: 204 - DNA, 20 bp, Artificial sequence
  Synthetic oligonucleotide
gggttggtgcggcaggcctg

SEQ ID NO: 205 - DNA, 20 bp, Artificial sequence
  Synthetic oligonucleotide
cacgggttggtgcggcaggc

SEQ ID NO: 206 - DNA, 20 bp, Artificial sequence
  Synthetic oligonucleotide
aggcacgggttggtgcggca

SEQ ID NO: 207 - DNA, 20 bp, Artificial sequence
  Synthetic oligonucleotide
tggaggcacgggttggtgcg

SEQ ID NO: 208 - DNA, 20 bp, Artificial sequence
  Synthetic oligonucleotide
cccccatggaggcacgggtt

SEQ ID NO: 209 - DNA, 20 bp, Artificial sequence
  Synthetic oligonucleotide
cgacccccatggaggcacgg

SEQ ID NO: 210 - DNA, 20 bp, Artificial sequence
  Synthetic oligonucleotide
cagcgacccccatggaggca

SEQ ID NO: 211 - DNA, 20 bp, Artificial sequence
  Synthetic oligonucleotide
aggcagcgacccccatggag

SEQ ID NO: 212 - DNA, 20 bp, Artificial sequence
  Synthetic oligonucleotide
tctaggcagcgacccccatg

SEQ ID NO: 213 - DNA, 20 bp, Artificial sequence
  Synthetic oligonucleotide
acctctaggcagcgaccccc

SEQ ID NO: 214 - DNA, 20 bp, Artificial sequence
  Synthetic oligonucleotide
ccctccacctctaggcagcg

SEQ ID NO: 215 - DNA, 20 bp, Artificial sequence
  Synthetic oligonucleotide
tggccctccacctctaggca

SEQ ID NO: 216 - DNA, 20 bp, Artificial sequence
  Synthetic oligonucleotide
aggcggtggccctccacctc

SEQ ID NO: 217 - DNA, 20 bp, Artificial sequence
  Synthetic oligonucleotide
cacaggcggtggccctccac

SEQ ID NO: 218 - DNA, 20 bp, Artificial sequence
  Synthetic oligonucleotide
cagtggcacaggcggtggcc

SEQ ID NO: 219 - DNA, 20 bp, Artificial sequence
  Synthetic oligonucleotide
gggcagtggcacaggcggtg

SEQ ID NO: 220 - DNA, 20 bp, Artificial sequence
  Synthetic oligonucleotide
gcggtagctgagcccgcggc

SEQ ID NO: 221 - DNA, 20 bp, Artificial sequence
  Synthetic oligonucleotide
cgtggtcctggccaggccgc

SEQ ID NO: 222 - DNA, 20 bp, Artificial sequence
  Synthetic oligonucleotide
cagttccgcgcttgctcggc

SEQ ID NO: 223 - DNA, 20 bp, Artificial sequence
  Synthetic oligonucleotide
ccccagttccgcgcttgctc

SEQ ID NO: 224 - DNA, 20 bp, Artificial sequence
  Synthetic oligonucleotide
tccccagttccgcgcttgct

SEQ ID NO: 225 - DNA, 20 bp, Artificial sequence
  Synthetic oligonucleotide
agtccccagttccgcgcttg

SEQ ID NO: 226 - DNA, 20 bp, Artificial sequence
  Synthetic oligonucleotide
cagtccccagttccgcgctt

SEQ ID NO: 227 - DNA, 20 bp, Artificial sequence
  Synthetic oligonucleotide
ccagtccccagttccgcgct

SEQ ID NO: 228 - DNA, 20 bp, Artificial sequence
  Synthetic oligonucleotide
cgcccagtccccagttccgc

SEQ ID NO: 229 - DNA, 20 bp, Artificial sequence
  Synthetic oligonucleotide
ggccgcccagtccccagttc

SEQ ID NO: 230 - DNA, 20 bp, Artificial sequence
  Synthetic oligonucleotide
cgtggccgcccagtccccag

SEQ ID NO: 231 - DNA, 20 bp, Artificial sequence
  Synthetic oligonucleotide
ccgggttccggcagaaggcg

SEQ ID NO: 232 - DNA, 20 bp, Artificial sequence
  Synthetic oligonucleotide
tgtccgggttccggcagaag

SEQ ID NO: 233 - DNA, 20 bp, Artificial sequence
  Synthetic oligonucleotide
ttgtccgggttccggcagaa

SEQ ID NO: 234 - DNA, 20 bp, Artificial sequence
  Synthetic oligonucleotide
acgaagcaccacgggcggat

SEQ ID NO: 235 - DNA, 20 bp, Artificial sequence
  Synthetic oligonucleotide
cttcggcggtgccggctgcg

SEQ ID NO: 236 - DNA, 20 bp, Artificial sequence
  Synthetic oligonucleotide
gcggagccgctgcccgcagc

SEQ ID NO: 237 - DNA, 20 bp, Artificial sequence
  Synthetic oligonucleotide
cttgcggagccgctgcccgc

SEQ ID NO: 238 - DNA, 20 bp, Artificial sequence
  Synthetic oligonucleotide
atggcatccgtccgttggtc

SEQ ID NO: 239 - DNA, 20 bp, Artificial sequence
  Synthetic oligonucleotide
tgactccaagctcaccagca

SEQ ID NO: 240 - DNA, 20 bp, Artificial sequence
  Synthetic oligonucleotide
ctcttcagctttgtacttat

SEQ ID NO: 241 - DNA, 20 bp, Artificial sequence
  Synthetic oligonucleotide
gcagggctccccggtgacag

SEQ ID NO: 242 - DNA, 20 bp, Artificial sequence
  Synthetic oligonucleotide
gcccttgtgggtacatttgt

SEQ ID NO: 243 - DNA, 20 bp, Artificial sequence
  Synthetic oligonucleotide
tatccccatcgctggtcctg

SEQ ID NO: 244 - DNA, 20 bp, Artificial sequence
  Synthetic oligonucleotide
gtttgctgcagtggtctttc

SEQ ID NO: 245 - DNA, 20 bp, Artificial sequence
  Synthetic oligonucleotide
aggtgttgtggacagagaca

SEQ ID NO: 246 - DNA, 20 bp, Artificial sequence
  Synthetic oligonucleotide
tgaggctcaaagcacttctc

SEQ ID NO: 247 - DNA, 20 bp, Artificial sequence
  Synthetic oligonucleotide
agttctataccatatctcat

SEQ ID NO: 248 - DNA, 20 bp, Artificial sequence
  Synthetic oligonucleotide
catcaggacccttgcactgg

SEQ ID NO: 249 - DNA, 20 bp, Artificial sequence
  Synthetic oligonucleotide
cggcaggcctggctggccag

SEQ ID NO: 250 - DNA, 20 bp, Artificial sequence
  Synthetic oligonucleotide
cacctctaggcagcgacccc

SEQ ID NO: 251 - DNA, 20 bp, Artificial sequence
  Synthetic oligonucleotide
aaggctccggtgtagcccac

SEQ ID NO: 252 - DNA, 20 bp, Artificial sequence
  Synthetic oligonucleotide
cgcggtagctgagcccgcgg

SEQ ID NO: 253 - DNA, 20 bp, Artificial sequence
  Synthetic oligonucleotide
ctccgaggcccacggctgac

SEQ ID NO: 254 - DNA, 20 bp, Artificial sequence
  Synthetic oligonucleotide
tcgcagtactcccagctcag

SEQ ID NO: 255 - DNA, 20 bp, Artificial sequence
  Synthetic oligonucleotide
tgccggctgcgcgggcatga

SEQ ID NO: 256 - DNA, 20 bp, Artificial sequence
  Synthetic oligonucleotide
ctgctcccgcttcgccggca

SEQ ID NO: 257 - DNA, 20 bp, Artificial sequence
  Synthetic oligonucleotide
ccgctgcccgcagctcagtg

SEQ ID NO: 258 - DNA, 20 bp, Artificial sequence
  Synthetic oligonucleotide
aacgacgcgggtcatcgaag

SEQ ID NO: 259 - DNA, 20 bp, Artificial sequence
  Synthetic oligonucleotide
ggcgcagaaactgtggcccc

SEQ ID NO: 260 - DNA, 20 bp, Artificial sequence
  Synthetic oligonucleotide
gagcaccaccgtcagatcct

SEQ ID NO: 261 - DNA, 20 bp, Artificial sequence
  Synthetic oligonucleotide
gtgcaagcggtaggagcgca

SEQ ID NO: 262 - DNA, 20 bp, Artificial sequence
  Synthetic oligonucleotide
gcgcgcagctgccgtccgca

SEQ ID NO: 263 - DNA, 20 bp, Artificial sequence
  Synthetic oligonucleotide
gccccagccggccacctggc

SEQ ID NO: 264 - DNA, 20 bp, Artificial sequence
  Synthetic oligonucleotide
ggcatattcctccgccccct

SEQ ID NO: 265 - DNA, 20 bp, Artificial sequence
  Synthetic oligonucleotide
ctccagggagaggaacggta

SEQ ID NO: 266 - DNA, 20 bp, Artificial sequence
  Synthetic oligonucleotide
ttggtcctcacacaccagcg

SEQ ID NO: 267 - DNA, 20 bp, Artificial sequence
  Synthetic oligonucleotide
gatccccagctgatgatgcc

SEQ ID NO: 268 - DNA, 20 bp, Artificial sequence
  Synthetic oligonucleotide
acgcctggcttgttgcggtc

SEQ ID NO: 269 - DNA, 20 bp, Artificial sequence
  Synthetic oligonucleotide
cggtgtgctcccggatccag

SEQ ID NO: 270 - DNA, 20 bp, Artificial sequence
  Synthetic oligonucleotide
ggaatcaccaaggagggaaa

SEQ ID NO: 271 - DNA, 20 bp, Artificial sequence
  Synthetic oligonucleotide
tcttgccttccatgccccag

SEQ ID NO: 272 - DNA, 20 bp, Artificial sequence
  Synthetic oligonucleotide
cactcaccgaaagtgttgac

SEQ ID NO: 273 - DNA, 20 bp, Artificial sequence
  Synthetic oligonucleotide
ccacaggtcatgagcagagg

SEQ ID NO: 274 - DNA, 20 bp, Artificial sequence
  Synthetic oligonucleotide
tgcccttgtatccacccagt

SEQ ID NO: 275 - DNA, 20 bp, Artificial sequence
  Synthetic oligonucleotide
cccagaaatgcagagatttc

SEQ ID NO: 276 - DNA, 20 bp, Artificial sequence
  Synthetic oligonucleotide
aatctacaagggagagaaga

SEQ ID NO: 277 - DNA, 20 bp, Artificial sequence
  Synthetic oligonucleotide
ggcactagactagactgccc

SEQ ID NO: 278 - DNA, 20 bp, Artificial sequence
  Synthetic oligonucleotide
cttagacacagcccataccc

SEQ ID NO: 279 - DNA, 20 bp, Artificial sequence
  Synthetic oligonucleotide
attgaaggccctggcctctg

SEQ ID NO: 280 - DNA, 20 bp, Artificial sequence
  Synthetic oligonucleotide
tcaaatccctcgcccagagt

SEQ ID NO: 281 - DNA, 20 bp, Artificial sequence
  Synthetic oligonucleotide
caggtgatgggctgaatacc

SEQ ID NO: 282 - DNA, 20 bp, Artificial sequence
  Synthetic oligonucleotide
aatttagtgtctggaagaat

SEQ ID NO: 283 - DNA, 20 bp, Artificial sequence
  Synthetic oligonucleotide
ccccaccaagtcaggcccac

SEQ ID NO: 284 - DNA, 20 bp, Artificial sequence
  Synthetic oligonucleotide
tggacggacagagaggaggg

SEQ ID NO: 285 - DNA, 20 bp, Artificial sequence
  Synthetic oligonucleotide
aggaccaaaccagaactagg

SEQ ID NO: 286 - DNA, 20 bp, Artificial sequence
  Synthetic oligonucleotide
tgtcttcttcagaggaattg

SEQ ID NO: 287 - DNA, 20 bp, Artificial sequence
  Synthetic oligonucleotide
ggctcacaggaacctaatac

SEQ ID NO: 288 - DNA, 20 bp, Artificial sequence
  Synthetic oligonucleotide
gattcaggtgtgtgctatag

SEQ ID NO: 289 - DNA, 20 bp, Artificial sequence
  Synthetic oligonucleotide
gtttttcacactttgtgctt

SEQ ID NO: 290 - DNA, 20 bp, Artificial sequence
  Synthetic oligonucleotide
gggcatgcacagagcagtga

SEQ ID NO: 291 - DNA, 20 bp, Artificial sequence
  Synthetic oligonucleotide
ctcattcttctctggttcta

SEQ ID NO: 292 - DNA, 20 bp, Artificial sequence
  Synthetic oligonucleotide
taggcacttaataatacttg

SEQ ID NO: 293 - DNA, 20 bp, Artificial sequence
  Synthetic oligonucleotide
ggagtcagatagctggagta

SEQ ID NO: 294 - DNA, 20 bp, Artificial sequence
  Synthetic oligonucleotide
ctcagggtctggtcaggaaa

SEQ ID NO: 295 - DNA, 20 bp, Artificial sequence
  Synthetic oligonucleotide
caggcccctgctccaactcc

SEQ ID NO: 296 - DNA, 20 bp, Artificial sequence
  Synthetic oligonucleotide
gagacaaggcttccctgctc

SEQ ID NO: 297 - DNA, 20 bp, Artificial sequence
  Synthetic oligonucleotide
gataccaggagagtaatgag

SEQ ID NO: 298 - DNA, 20 bp, Artificial sequence
  Synthetic oligonucleotide
aagcttggtttacccacctg

SEQ ID NO: 299 - DNA, 20 bp, Artificial sequence
  Synthetic oligonucleotide
gagagatggacatggtggaa

SEQ ID NO: 300 - DNA, 20 bp, Artificial sequence
  Synthetic oligonucleotide
ccagcaacctattctgtagg

SEQ ID NO: 301 - DNA, 20 bp, Artificial sequence
  Synthetic oligonucleotide
ctccctggcccgttcccaac

SEQ ID NO: 302 - DNA, 20 bp, Artificial sequence
  Synthetic oligonucleotide
aacgcagtgagccacccctg

SEQ ID NO: 303 - DNA, 20 bp, Artificial sequence
  Synthetic oligonucleotide
ctgggctctcctgcctccct

SEQ ID NO: 304 - DNA, 20 bp, Artificial sequence
  Synthetic oligonucleotide
ttcccccccccacttcctaa

SEQ ID NO: 305 - DNA, 20 bp, Artificial sequence
  Synthetic oligonucleotide
gagacggaggagccgcggcc

SEQ ID NO: 306 - DNA, 20 bp, Artificial sequence
  Synthetic oligonucleotide
aacccgggcggagaggagcg

SEQ ID NO: 307 - DNA, 20 bp, Artificial sequence
  Synthetic oligonucleotide
ggcttcttccgcctaaccca

SEQ ID NO: 308 - DNA, 20 bp, Artificial sequence
  Synthetic oligonucleotide
tgaatcccaggccctgggat

SEQ ID NO: 309 - DNA, 20 bp, Artificial sequence
  Synthetic oligonucleotide
gagtcgcagaacctggctcc

SEQ ID NO: 310 - DNA, 20 bp, Artificial sequence
  Synthetic oligonucleotide
atttcataggcaaggaggct

SEQ ID NO: 311 - DNA, 20 bp, Artificial sequence
  Synthetic oligonucleotide
cttcacaccccatctgacaa

SEQ ID NO: 312 - DNA, 20 bp, Artificial sequence
  Synthetic oligonucleotide
gaatcaccctgggtcggaaa

SEQ ID NO: 313 - DNA, 20 bp, Artificial sequence
  Synthetic oligonucleotide
gtccgggttccggcagaagg

SEQ ID NO: 314 - DNA, 20 bp, Artificial sequence
  Synthetic oligonucleotide
catggcatccgtccgttggt

SEQ ID NO: 315 - DNA, 20 bp, Artificial sequence
  Synthetic oligonucleotide
ttgactccaagctcaccagc

SEQ ID NO: 316 - DNA, 20 bp, Artificial sequence
  Synthetic oligonucleotide
gctcttcagctttgtactta

SEQ ID NO: 317 - DNA, 20 bp, Artificial sequence
  Synthetic oligonucleotide
ggcagggctccccggtgaca

SEQ ID NO: 318 - DNA, 20 bp, Artificial sequence
  Synthetic oligonucleotide
ggcccttgtgggtacatttg

SEQ ID NO: 319 - DNA, 20 bp, Artificial sequence
  Synthetic oligonucleotide
agtatccccatcgctggtcc

SEQ ID NO: 320 - DNA, 20 bp, Artificial sequence
  Synthetic oligonucleotide
tgtttgctgcagtggtcttt

SEQ ID NO: 321 - DNA, 20 bp, Artificial sequence
  Synthetic oligonucleotide
gaggtgttgtggacagagac

SEQ ID NO: 322 - DNA, 20 bp, Artificial sequence
  Synthetic oligonucleotide
ctgaggctcaaagcacttct

SEQ ID NO: 323 - DNA, 20 bp, Artificial sequence
  Synthetic oligonucleotide
gctcagttctataccatatc

SEQ ID NO: 324 - DNA, 20 bp, Artificial sequence
  Synthetic oligonucleotide
gcatcaggacccttgcactg

SEQ ID NO: 325 - DNA, 20 bp, Artificial sequence
  Synthetic oligonucleotide
tgcggcaggcctggctggcc

SEQ ID NO: 326 - DNA, 20 bp, Artificial sequence
  Synthetic oligonucleotide
ccacctctaggcagcgaccc

SEQ ID NO: 327 - DNA, 20 bp, Artificial sequence
  Synthetic oligonucleotide
gaaggctccggtgtagccca

SEQ ID NO: 328 - DNA, 20 bp, Artificial sequence
  Synthetic oligonucleotide
ccgcggtagctgagcccgcg

SEQ ID NO: 329 - DNA, 20 bp, Artificial sequence
  Synthetic oligonucleotide
cctccgaggcccacggctga

SEQ ID NO: 330 - DNA, 20 bp, Artificial sequence
  Synthetic oligonucleotide
gtcgcagtactcccagctca

SEQ ID NO: 331 - DNA, 20 bp, Artificial sequence
  Synthetic oligonucleotide
gtgccggctgcgcgggcatg

SEQ ID NO: 332 - DNA, 20 bp, Artificial sequence
  Synthetic oligonucleotide
gctgctcccgcttcgccggc

SEQ ID NO: 333 - DNA, 20 bp, Artificial sequence
  Synthetic oligonucleotide
gccgctgcccgcagctcagt

SEQ ID NO: 334 - DNA, 20 bp, Artificial sequence
  Synthetic oligonucleotide
caacgacgcgggtcatcgaa

SEQ ID NO: 335 - DNA, 20 bp, Artificial sequence
  Synthetic oligonucleotide
cggcgcagaaactgtggccc

SEQ ID NO: 336 - DNA, 20 bp, Artificial sequence
  Synthetic oligonucleotide
cgagcaccaccgtcagatcc

SEQ ID NO: 337 - DNA, 20 bp, Artificial sequence
  Synthetic oligonucleotide
cgtgcaagcggtaggagcgc

SEQ ID NO: 338 - DNA, 20 bp, Artificial sequence
  Synthetic oligonucleotide
agcgcgcagctgccgtccgc

SEQ ID NO: 339 - DNA, 20 bp, Artificial sequence
  Synthetic oligonucleotide
ggccccagccggccacctgg

SEQ ID NO: 340 - DNA, 20 bp, Artificial sequence
  Synthetic oligonucleotide
tggcatattcctccgccccc

SEQ ID NO: 341 - DNA, 20 bp, Artificial sequence
  Synthetic oligonucleotide
gctccagggagaggaacggt

SEQ ID NO: 342 - DNA, 20 bp, Artificial sequence
  Synthetic oligonucleotide
cttggtcctcacacaccagc

SEQ ID NO: 343 - DNA, 20 bp, Artificial sequence
  Synthetic oligonucleotide
cgatccccagctgatgatgc

SEQ ID NO: 344 - DNA, 20 bp, Artificial sequence
  Synthetic oligonucleotide
acggtgtgctcccggatcca

SEQ ID NO: 345 - DNA, 20 bp, Artificial sequence
  Synthetic oligonucleotide
cggaatcaccaaggagggaa

SEQ ID NO: 346 - DNA, 20 bp, Artificial sequence
  Synthetic oligonucleotide
atcttgccttccatgcccca

SEQ ID NO: 347 - DNA, 20 bp, Artificial sequence
  Synthetic oligonucleotide
tgagttcctgcgccatcctg

SEQ ID NO: 348 - DNA, 20 bp, Artificial sequence
  Synthetic oligonucleotide
cagcactcaccgaaagtgtt

SEQ ID NO: 349 - DNA, 20 bp, Artificial sequence
  Synthetic oligonucleotide
gacccacaggtcatgagcag

SEQ ID NO: 350 - DNA, 20 bp, Artificial sequence
  Synthetic oligonucleotide
ctgtgcccttgtatccaccc

SEQ ID NO: 351 - DNA, 20 bp, Artificial sequence
  Synthetic oligonucleotide
cagcccagaaatgcagagat

SEQ ID NO: 352 - DNA, 20 bp, Artificial sequence
  Synthetic oligonucleotide
tggaatctacaagggagaga

SEQ ID NO: 353 - DNA, 20 bp, Artificial sequence
  Synthetic oligonucleotide
gtaggcactagactagactg

SEQ ID NO: 354 - DNA, 20 bp, Artificial sequence
  Synthetic oligonucleotide
gcacttagacacagcccata

SEQ ID NO: 355 - DNA, 20 bp, Artificial sequence
  Synthetic oligonucleotide
cccattgaaggccctggcct

SEQ ID NO: 356 - DNA, 20 bp, Artificial sequence
  Synthetic oligonucleotide
aactcaaatccctcgcccag

SEQ ID NO: 357 - DNA, 20 bp, Artificial sequence
  Synthetic oligonucleotide
caccaggtgatgggctgaat

SEQ ID NO: 358 - DNA, 20 bp, Artificial sequence
  Synthetic oligonucleotide
ggtaatttagtgtctggaag

SEQ ID NO: 359 - DNA, 20 bp, Artificial sequence
  Synthetic oligonucleotide
caaccccaccaagtcaggcc

SEQ ID NO: 360 - DNA, 20 bp, Artificial sequence
  Synthetic oligonucleotide
ggatggacggacagagagga

SEQ ID NO: 361 - DNA, 20 bp, Artificial sequence
  Synthetic oligonucleotide
ccaaggaccaaaccagaact

SEQ ID NO: 362 - DNA, 20 bp, Artificial sequence
  Synthetic oligonucleotide
ctgtgtcttcttcagaggaa

SEQ ID NO: 363 - DNA, 20 bp, Artificial sequence
  Synthetic oligonucleotide
tgttggttgatgaaaatgtt

SEQ ID NO: 364 - DNA, 20 bp, Artificial sequence
  Synthetic oligonucleotide
cttgattcaggtgtgtgcta

SEQ ID NO: 365 - DNA, 20 bp, Artificial sequence
  Synthetic oligonucleotide
tcagtctacttagtgcaacg

SEQ ID NO: 366 - DNA, 20 bp, Artificial sequence
  Synthetic oligonucleotide
tttgtgggcatgcacagagc

SEQ ID NO: 367 - DNA, 20 bp, Artificial sequence
  Synthetic oligonucleotide
atcctcattcttctctggtt

SEQ ID NO: 368 - DNA, 20 bp, Artificial sequence
  Synthetic oligonucleotide
aagtaggcacttaataatac

SEQ ID NO: 369 - DNA, 20 bp, Artificial sequence
  Synthetic oligonucleotide
tcaggagtcagatagctgga

SEQ ID NO: 370 - DNA, 20 bp, Artificial sequence
  Synthetic oligonucleotide
tccctcagggtctggtcagg

SEQ ID NO: 371 - DNA, 20 bp, Artificial sequence
  Synthetic oligonucleotide
gtctcccaggcccctgctcc

SEQ ID NO: 372 - DNA, 20 bp, Artificial sequence
  Synthetic oligonucleotide
tagaaagagacaaggcttcc

SEQ ID NO: 373 - DNA, 20 bp, Artificial sequence
  Synthetic oligonucleotide
ggtgataccaggagagtaat

SEQ ID NO: 374 - DNA, 20 bp, Artificial sequence
  Synthetic oligonucleotide
tccaagcttggtttacccac

SEQ ID NO: 375 - DNA, 20 bp, Artificial sequence
  Synthetic oligonucleotide
tctgagagatggacatggtg

SEQ ID NO: 376 - DNA, 20 bp, Artificial sequence
  Synthetic oligonucleotide
tatccagcaacctattctgt

SEQ ID NO: 377 - DNA, 20 bp, Artificial sequence
  Synthetic oligonucleotide
ctcctccctggcccgttccc

SEQ ID NO: 378 - DNA, 20 bp, Artificial sequence
  Synthetic oligonucleotide
gggaacgcagtgagccaccc

SEQ ID NO: 379 - DNA, 20 bp, Artificial sequence
  Synthetic oligonucleotide
aggctgggctctcctgcctc

SEQ ID NO: 380 - DNA, 20 bp, Artificial sequence
  Synthetic oligonucleotide
tccttcccccccccacttcc

SEQ ID NO: 381 - DNA, 20 bp, Artificial sequence
  Synthetic oligonucleotide
tgggagacggaggagccgcg

SEQ ID NO: 382 - DNA, 20 bp, Artificial sequence
  Synthetic oligonucleotide
gctaacccgggcggagagga

SEQ ID NO: 383 - DNA, 20 bp, Artificial sequence
  Synthetic oligonucleotide
gcgggcttcttccgcctaac

SEQ ID NO: 384 - DNA, 20 bp, Artificial sequence
  Synthetic oligonucleotide
cagtgaatcccaggccctgg

SEQ ID NO: 385 - DNA, 20 bp, Artificial sequence
  Synthetic oligonucleotide
ccagagtcgcagaacctggc

SEQ ID NO: 386 - DNA, 20 bp, Artificial sequence
  Synthetic oligonucleotide
tcaatttcataggcaaggag

SEQ ID NO: 387 - DNA, 20 bp, Artificial sequence
  Synthetic oligonucleotide
cttcttcacaccccatctga

SEQ ID NO: 388 - DNA, 20 bp, Artificial sequence
  Synthetic oligonucleotide
ccggaatcaccctgggtcgg

SEQ ID NO: 389 - DNA, 20 bp, Artificial sequence
  Synthetic oligonucleotide
gttgactccaagctcaccag

SEQ ID NO: 390 - DNA, 20 bp, Artificial sequence
  Synthetic oligonucleotide
gtgctcttcagctttgtact

SEQ ID NO: 391 - DNA, 20 bp, Artificial sequence
  Synthetic oligonucleotide
gtggcagggctccccggtga

SEQ ID NO: 392 - DNA, 20 bp, Artificial sequence
  Synthetic oligonucleotide
ccggcccttgtgggtacatt

SEQ ID NO: 393 - DNA, 20 bp, Artificial sequence
  Synthetic oligonucleotide
cagtatccccatcgctggtc

SEQ ID NO: 394 - DNA, 20 bp, Artificial sequence
  Synthetic oligonucleotide
gtgtttgctgcagtggtctt

SEQ ID NO: 395 - DNA, 20 bp, Artificial sequence
  Synthetic oligonucleotide
tgaggtgttgtggacagaga

SEQ ID NO: 396 - DNA, 20 bp, Artificial sequence
  Synthetic oligonucleotide
agctgaggctcaaagcactt

SEQ ID NO: 397 - DNA, 20 bp, Artificial sequence
  Synthetic oligonucleotide
tgctcagttctataccatat

SEQ ID NO: 398 - DNA, 20 bp, Artificial sequence
  Synthetic oligonucleotide
gggcatcaggacccttgcac

SEQ ID NO: 399 - DNA, 20 bp, Artificial sequence
  Synthetic oligonucleotide
gtgcggcaggcctggctggc

SEQ ID NO: 400 - DNA, 20 bp, Artificial sequence
  Synthetic oligonucleotide
ctccacctctaggcagcgac

SEQ ID NO: 401 - DNA, 20 bp, Artificial sequence
  Synthetic oligonucleotide
agaaggctccggtgtagccc

SEQ ID NO: 402 - DNA, 20 bp, Artificial sequence
  Synthetic oligonucleotide
gccgcggtagctgagcccgc

SEQ ID NO: 403 - DNA, 20 bp, Artificial sequence
  Synthetic oligonucleotide
ggcctccgaggcccacggct

SEQ ID NO: 404 - DNA, 20 bp, Artificial sequence
  Synthetic oligonucleotide
gttgtccgggttccggcaga

SEQ ID NO: 405 - DNA, 20 bp, Artificial sequence
  Synthetic oligonucleotide
ggtcgcagtactcccagctc

SEQ ID NO: 406 - DNA, 20 bp, Artificial sequence
  Synthetic oligonucleotide
cggtgccggctgcgcgggca

SEQ ID NO: 407 - DNA, 20 bp, Artificial sequence
  Synthetic oligonucleotide
ggctgctcccgcttcgccgg

SEQ ID NO: 408 - DNA, 20 bp, Artificial sequence
  Synthetic oligonucleotide
agccgctgcccgcagctcag

SEQ ID NO: 409 - DNA, 20 bp, Artificial sequence
  Synthetic oligonucleotide
gccaacgacgcgggtcatcg

SEQ ID NO: 410 - DNA, 20 bp, Artificial sequence
  Synthetic oligonucleotide
gccggcgcagaaactgtggc

SEQ ID NO: 411 - DNA, 20 bp, Artificial sequence
  Synthetic oligonucleotide
ccgagcaccaccgtcagatc

SEQ ID NO: 412 - DNA, 20 bp, Artificial sequence
  Synthetic oligonucleotide
tgacgggcgagaaggcctcg

SEQ ID NO: 413 - DNA, 20 bp, Artificial sequence
  Synthetic oligonucleotide
ggagcgcgcagctgccgtcc

SEQ ID NO: 414 - DNA, 20 bp, Artificial sequence
  Synthetic oligonucleotide
tggccccagccggccacctg

SEQ ID NO: 415 - DNA, 20 bp, Artificial sequence
  Synthetic oligonucleotide
gctggcatattcctccgccc

SEQ ID NO: 416 - DNA, 20 bp, Artificial sequence
  Synthetic oligonucleotide
cgctccagggagaggaacgg

SEQ ID NO: 417 - DNA, 20 bp, Artificial sequence
  Synthetic oligonucleotide
ccgatccccagctgatgatg

SEQ ID NO: 418 - DNA, 20 bp, Artificial sequence
  Synthetic oligonucleotide
gtaggccacatcggtgtaga

SEQ ID NO: 419 - DNA, 20 bp, Artificial sequence
  Synthetic oligonucleotide
aaacggtgtgctcccggatc

SEQ ID NO: 420 - DNA, 20 bp, Artificial sequence
  Synthetic oligonucleotide
gcggaatcaccaaggaggga

SEQ ID NO: 421 - DNA, 20 bp, Artificial sequence
  Synthetic oligonucleotide
aatcttgccttccatgcccc

SEQ ID NO: 422 - DNA, 20 bp, Artificial sequence
  Synthetic oligonucleotide
ttgagttcctgcgccatcct

SEQ ID NO: 423 - DNA, 20 bp, Artificial sequence
  Synthetic oligonucleotide
ccacagcactcaccgaaagt

SEQ ID NO: 424 - DNA, 20 bp, Artificial sequence
  Synthetic oligonucleotide
ctggacccacaggtcatgag

SEQ ID NO: 425 - DNA, 20 bp, Artificial sequence
  Synthetic oligonucleotide
aggctgtgcccttgtatcca

SEQ ID NO: 426 - DNA, 20 bp, Artificial sequence
  Synthetic oligonucleotide
tcacagcccagaaatgcaga

SEQ ID NO: 427 - DNA, 20 bp, Artificial sequence
  Synthetic oligonucleotide
aggtggaatctacaagggag

SEQ ID NO: 428 - DNA, 20 bp, Artificial sequence
  Synthetic oligonucleotide
caggtaggcactagactaga

SEQ ID NO: 429 - DNA, 20 bp, Artificial sequence
  Synthetic oligonucleotide
tgggcacttagacacagccc

SEQ ID NO: 430 - DNA, 20 bp, Artificial sequence
  Synthetic oligonucleotide
ttgcccattgaaggccctgg

SEQ ID NO: 431 - DNA, 20 bp, Artificial sequence
  Synthetic oligonucleotide
gagaactcaaatccctcgcc

SEQ ID NO: 432 - DNA, 20 bp, Artificial sequence
  Synthetic oligonucleotide
atgcaccaggtgatgggctg

SEQ ID NO: 433 - DNA, 20 bp, Artificial sequence
  Synthetic oligonucleotide
gtaggtaatttagtgtctgg

SEQ ID NO: 434 - DNA, 20 bp, Artificial sequence
  Synthetic oligonucleotide
actcaaccccaccaagtcag

SEQ ID NO: 435 - DNA, 20 bp, Artificial sequence
  Synthetic oligonucleotide
atgggatggacggacagaga

SEQ ID NO: 436 - DNA, 20 bp, Artificial sequence
  Synthetic oligonucleotide
ttgccaaggaccaaaccaga

SEQ ID NO: 437 - DNA, 20 bp, Artificial sequence
  Synthetic oligonucleotide
tgcctgtgtcttcttcagag

SEQ ID NO: 438 - DNA, 20 bp, Artificial sequence
  Synthetic oligonucleotide
tgctgttggttgatgaaaat

SEQ ID NO: 439 - DNA, 20 bp, Artificial sequence
  Synthetic oligonucleotide
acacttgattcaggtgtgtg

SEQ ID NO: 440 - DNA, 20 bp, Artificial sequence
  Synthetic oligonucleotide
tccttctcagtctacttagt

SEQ ID NO: 441 - DNA, 20 bp, Artificial sequence
  Synthetic oligonucleotide
ccatttgtgggcatgcacag

SEQ ID NO: 442 - DNA, 20 bp, Artificial sequence
  Synthetic oligonucleotide
ttgatcctcattcttctctg

SEQ ID NO: 443 - DNA, 20 bp, Artificial sequence
  Synthetic oligonucleotide
ttgccacaaagtaggcactt

SEQ ID NO: 444 - DNA, 20 bp, Artificial sequence
  Synthetic oligonucleotide
ggttcaggagtcagatagct

SEQ ID NO: 445 - DNA, 20 bp, Artificial sequence
  Synthetic oligonucleotide
ctgtccctcagggtctggtc

SEQ ID NO: 446 - DNA, 20 bp, Artificial sequence
  Synthetic oligonucleotide
catgtctcccaggcccctgc

SEQ ID NO: 447 - DNA, 20 bp, Artificial sequence
  Synthetic oligonucleotide
ctgtagaaagagacaaggct

SEQ ID NO: 448 - DNA, 20 bp, Artificial sequence
  Synthetic oligonucleotide
tctggtgataccaggagagt

SEQ ID NO: 449 - DNA, 20 bp, Artificial sequence
  Synthetic oligonucleotide
gtttccaagcttggtttacc

SEQ ID NO: 450 - DNA, 20 bp, Artificial sequence
  Synthetic oligonucleotide
tggtctgagagatggacatg

SEQ ID NO: 451 - DNA, 20 bp, Artificial sequence
  Synthetic oligonucleotide
gagtatccagcaacctattc

SEQ ID NO: 452 - DNA, 20 bp, Artificial sequence
  Synthetic oligonucleotide
acgctcctccctggcccgtt

SEQ ID NO: 453 - DNA, 20 bp, Artificial sequence
  Synthetic oligonucleotide
ggagggaacgcagtgagcca

SEQ ID NO: 454 - DNA, 20 bp, Artificial sequence
  Synthetic oligonucleotide
gccaaggctgggctctcctg

SEQ ID NO: 455 - DNA, 20 bp, Artificial sequence
  Synthetic oligonucleotide
tcctccttcccccccccact

SEQ ID NO: 456 - DNA, 20 bp, Artificial sequence
  Synthetic oligonucleotide
cgctgggagacggaggagcc

SEQ ID NO: 457 - DNA, 20 bp, Artificial sequence
  Synthetic oligonucleotide
agagctaacccgggcggaga

SEQ ID NO: 458 - DNA, 20 bp, Artificial sequence
  Synthetic oligonucleotide
gtcgcgggcttcttccgcct

SEQ ID NO: 459 - DNA, 20 bp, Artificial sequence
  Synthetic oligonucleotide
cagcagtgaatcccaggccc

SEQ ID NO: 460 - DNA, 20 bp, Artificial sequence
  Synthetic oligonucleotide
catccagagtcgcagaacct

SEQ ID NO: 461 - DNA, 20 bp, Artificial sequence
  Synthetic oligonucleotide
aattcaatttcataggcaag

SEQ ID NO: 462 - DNA, 20 bp, Artificial sequence
  Synthetic oligonucleotide
cgccttcttcacaccccatc

SEQ ID NO: 463 - DNA, 20 bp, Artificial sequence
  Synthetic oligonucleotide
cctccggaatcaccctgggt

SEQ ID NO: 464 - DNA, 20 bp, Artificial sequence
  Synthetic oligonucleotide
aggagcgcgcagctgccgtc

SEQ ID NO: 465 - DNA, 20 bp, Artificial sequence
  Synthetic oligonucleotide
gtgttgactccaagctcacc

SEQ ID NO: 466 - DNA, 20 bp, Artificial sequence
  Synthetic oligonucleotide
tgtgctcttcagctttgtac

SEQ ID NO: 467 - DNA, 20 bp, Artificial sequence
  Synthetic oligonucleotide
agtggcagggctccccggtg

SEQ ID NO: 468 - DNA, 20 bp, Artificial sequence
  Synthetic oligonucleotide
gccggcccttgtgggtacat

SEQ ID NO: 469 - DNA, 20 bp, Artificial sequence
  Synthetic oligonucleotide
acagtatccccatcgctggt

SEQ ID NO: 470 - DNA, 20 bp, Artificial sequence
  Synthetic oligonucleotide
tgtgtttgctgcagtggtct

SEQ ID NO: 471 - DNA, 20 bp, Artificial sequence
  Synthetic oligonucleotide
gtgaggtgttgtggacagag

SEQ ID NO: 472 - DNA, 20 bp, Artificial sequence
  Synthetic oligonucleotide
aagctgaggctcaaagcact

SEQ ID NO: 473 - DNA, 20 bp, Artificial sequence
  Synthetic oligonucleotide
ttgctcagttctataccata

SEQ ID NO: 474 - DNA, 20 bp, Artificial sequence
  Synthetic oligonucleotide
tgggcatcaggacccttgca

SEQ ID NO: 475 - DNA, 20 bp, Artificial sequence
  Synthetic oligonucleotide
ggtgcggcaggcctggctgg

SEQ ID NO: 476 - DNA, 20 bp, Artificial sequence
  Synthetic oligonucleotide
cctccacctctaggcagcga

SEQ ID NO: 477 - DNA, 20 bp, Artificial sequence
  Synthetic oligonucleotide
cagaaggctccggtgtagcc

SEQ ID NO: 478 - DNA, 20 bp, Artificial sequence
  Synthetic oligonucleotide
ggccgcggtagctgagcccg

SEQ ID NO: 479 - DNA, 20 bp, Artificial sequence
  Synthetic oligonucleotide
tggcctccgaggcccacggc

SEQ ID NO: 480 - DNA, 20 bp, Artificial sequence
  Synthetic oligonucleotide
cgttgtccgggttccggcag

SEQ ID NO: 481 - DNA, 20 bp, Artificial sequence
  Synthetic oligonucleotide
aggtcgcagtactcccagct

SEQ ID NO: 482 - DNA, 20 bp, Artificial sequence
  Synthetic oligonucleotide
gcggtgccggctgcgcgggc

SEQ ID NO: 483 - DNA, 20 bp, Artificial sequence
  Synthetic oligonucleotide
gcggctgctcccgcttcgcc

SEQ ID NO: 484 - DNA, 20 bp, Artificial sequence
  Synthetic oligonucleotide
ggagccgctgcccgcagctc

SEQ ID NO: 485 - DNA, 20 bp, Artificial sequence
  Synthetic oligonucleotide
cgccaacgacgcgggtcatc

SEQ ID NO: 486 - DNA, 20 bp, Artificial sequence
  Synthetic oligonucleotide
tgccggcgcagaaactgtgg

SEQ ID NO: 487 - DNA, 20 bp, Artificial sequence
  Synthetic oligonucleotide
gccgagcaccaccgtcagat

SEQ ID NO: 488 - DNA, 20 bp, Artificial sequence
  Synthetic oligonucleotide
ctgacgggcgagaaggcctc

SEQ ID NO: 489 - DNA, 20 bp, Artificial sequence
  Synthetic oligonucleotide
gtggccccagccggccacct

SEQ ID NO: 490 - DNA, 20 bp, Artificial sequence
  Synthetic oligonucleotide
agctggcatattcctccgcc

SEQ ID NO: 491 - DNA, 20 bp, Artificial sequence
  Synthetic oligonucleotide
gcgctccagggagaggaacg

SEQ ID NO: 492 - DNA, 20 bp, Artificial sequence
  Synthetic oligonucleotide
agcttggtcctcacacacca

SEQ ID NO: 493 - DNA, 20 bp, Artificial sequence
  Synthetic oligonucleotide
cccgatccccagctgatgat

SEQ ID NO: 494 - DNA, 20 bp, Artificial sequence
  Synthetic oligonucleotide
agtaggccacatcggtgtag

SEQ ID NO: 495 - DNA, 20 bp, Artificial sequence
  Synthetic oligonucleotide
gaaacggtgtgctcccggat

SEQ ID NO: 496 - DNA, 20 bp, Artificial sequence
  Synthetic oligonucleotide
tgcggaatcaccaaggaggg

SEQ ID NO: 497 - DNA, 20 bp, Artificial sequence
  Synthetic oligonucleotide
acaatcttgccttccatgcc

SEQ ID NO: 498 - DNA, 20 bp, Artificial sequence
  Synthetic oligonucleotide
tattgagttcctgcgccatc

SEQ ID NO: 499 - DNA, 20 bp, Artificial sequence
  Synthetic oligonucleotide
ttcccacagcactcaccgaa

SEQ ID NO: 500 - DNA, 20 bp, Artificial sequence
  Synthetic oligonucleotide
cacctggacccacaggtcat

SEQ ID NO: 501 - DNA, 20 bp, Artificial sequence
  Synthetic oligonucleotide
tgcaggctgtgcccttgtat

SEQ ID NO: 502 - DNA, 20 bp, Artificial sequence
  Synthetic oligonucleotide
ctctcacagcccagaaatgc

SEQ ID NO: 503 - DNA, 20 bp, Artificial sequence
  Synthetic oligonucleotide
ccaaggtggaatctacaagg

SEQ ID NO: 504 - DNA, 20 bp, Artificial sequence
  Synthetic oligonucleotide
caccaggtaggcactagact

SEQ ID NO: 505 - DNA, 20 bp, Artificial sequence
  Synthetic oligonucleotide
cctgctccgagccaggctcg

SEQ ID NO: 506 - DNA, 20 bp, Artificial sequence
  Synthetic oligonucleotide
tccttgcccattgaaggccc

SEQ ID NO: 507 - DNA, 20 bp, Artificial sequence
  Synthetic oligonucleotide
ttggagaactcaaatccctc

SEQ ID NO: 508 - DNA, 20 bp, Artificial sequence
  Synthetic oligonucleotide
tccatgcaccaggtgatggg

SEQ ID NO: 509 - DNA, 20 bp, Artificial sequence
  Synthetic oligonucleotide
catgtaggtaatttagtgtc

SEQ ID NO: 510 - DNA, 20 bp, Artificial sequence
  Synthetic oligonucleotide
gagactcaaccccaccaagt

SEQ ID NO: 511 - DNA, 20 bp, Artificial sequence
  Synthetic oligonucleotide
cagatgggatggacggacag

SEQ ID NO: 512 - DNA, 20 bp, Artificial sequence
  Synthetic oligonucleotide
cacttgccaaggaccaaacc

SEQ ID NO: 513 - DNA, 20 bp, Artificial sequence
  Synthetic oligonucleotide
aattgcctgtgtcttcttca

SEQ ID NO: 514 - DNA, 20 bp, Artificial sequence
  Synthetic oligonucleotide
atatgctgttggttgatgaa

SEQ ID NO: 515 - DNA, 20 bp, Artificial sequence
  Synthetic oligonucleotide
tagacacttgattcaggtgt

SEQ ID NO: 516 - DNA, 20 bp, Artificial sequence
  Synthetic oligonucleotide
gtgtccttctcagtctactt

SEQ ID NO: 517 - DNA, 20 bp, Artificial sequence
  Synthetic oligonucleotide
tggccatttgtgggcatgca

SEQ ID NO: 518 - DNA, 20 bp, Artificial sequence
  Synthetic oligonucleotide
cagttgatcctcattcttct

SEQ ID NO: 519 - DNA, 20 bp, Artificial sequence
  Synthetic oligonucleotide
cacttgccacaaagtaggca

SEQ ID NO: 520 - DNA, 20 bp, Artificial sequence
  Synthetic oligonucleotide
ttgggttcaggagtcagata

SEQ ID NO: 521 - DNA, 20 bp, Artificial sequence
  Synthetic oligonucleotide
gcactgtccctcagggtctg

SEQ ID NO: 522 - DNA, 20 bp, Artificial sequence
  Synthetic oligonucleotide
gtacatgtctcccaggcccc

SEQ ID NO: 523 - DNA, 20 bp, Artificial sequence
  Synthetic oligonucleotide
cacctgtagaaagagacaag

SEQ ID NO: 524 - DNA, 20 bp, Artificial sequence
  Synthetic oligonucleotide
gggtctggtgataccaggag

SEQ ID NO: 525 - DNA, 20 bp, Artificial sequence
  Synthetic oligonucleotide
caagtttccaagcttggttt

SEQ ID NO: 526 - DNA, 20 bp, Artificial sequence
  Synthetic oligonucleotide
cagtggtctgagagatggac

SEQ ID NO: 527 - DNA, 20 bp, Artificial sequence
  Synthetic oligonucleotide
tccgagtatccagcaaccta

SEQ ID NO: 528 - DNA, 20 bp, Artificial sequence
  Synthetic oligonucleotide
ccagcctgtcttcctgacgc

SEQ ID NO: 529 - DNA, 20 bp, Artificial sequence
  Synthetic oligonucleotide
gttggtgcggcaggcttggg

SEQ ID NO: 530 - DNA, 20 bp, Artificial sequence
  Synthetic oligonucleotide
gcagccaaggctgggctctc

SEQ ID NO: 531 - DNA, 20 bp, Artificial sequence
  Synthetic oligonucleotide
ggctcctccttccccccccc

SEQ ID NO: 532 - DNA, 20 bp, Artificial sequence
  Synthetic oligonucleotide
ctgcgctgggagacggagga

SEQ ID NO: 533 - DNA, 20 bp, Artificial sequence
  Synthetic oligonucleotide
aacagagctaacccgggcgg

SEQ ID NO: 534 - DNA, 20 bp, Artificial sequence
  Synthetic oligonucleotide
aaagtcgcgggcttcttccg

SEQ ID NO: 535 - DNA, 20 bp, Artificial sequence
  Synthetic oligonucleotide
tcccagcagtgaatcccagg

SEQ ID NO: 536 - DNA, 20 bp, Artificial sequence
  Synthetic oligonucleotide
acccatccagagtcgcagaa

SEQ ID NO: 537 - DNA, 20 bp, Artificial sequence
  Synthetic oligonucleotide
attaattcaatttcataggc

SEQ ID NO: 538 - DNA, 20 bp, Artificial sequence
  Synthetic oligonucleotide
cccctgcgaacacagagcgc

SEQ ID NO: 539 - DNA, 20 bp, Artificial sequence
  Synthetic oligonucleotide
agcaccacgggcggatgtcg

SEQ ID NO: 540 - DNA, 20 bp, Artificial sequence
  Synthetic oligonucleotide
cctcatggcatccgtccgtt

SEQ ID NO: 541 - DNA, 20 bp, Artificial sequence
  Synthetic oligonucleotide
agtgttgactccaagctcac

SEQ ID NO: 542 - DNA, 20 bp, Artificial sequence
  Synthetic oligonucleotide
tgtgtgctcttcagctttgt

SEQ ID NO: 543 - DNA, 20 bp, Artificial sequence
  Synthetic oligonucleotide
gaagtggcagggctccccgg

SEQ ID NO: 544 - DNA, 20 bp, Artificial sequence
  Synthetic oligonucleotide
tggccggcccttgtgggtac

SEQ ID NO: 545 - DNA, 20 bp, Artificial sequence
  Synthetic oligonucleotide
aaacagtatccccatcgctg

SEQ ID NO: 546 - DNA, 20 bp, Artificial sequence
  Synthetic oligonucleotide
ctgtgtttgctgcagtggtc

SEQ ID NO: 547 - DNA, 20 bp, Artificial sequence
  Synthetic oligonucleotide
agtgaggtgttgtggacaga

SEQ ID NO: 548 - DNA, 20 bp, Artificial sequence
  Synthetic oligonucleotide
gaagctgaggctcaaagcac

SEQ ID NO: 549 - DNA, 20 bp, Artificial sequence
  Synthetic oligonucleotide
cttgctcagttctataccat

SEQ ID NO: 550 - DNA, 20 bp, Artificial sequence
  Synthetic oligonucleotide
gtgggcatcaggacccttgc

SEQ ID NO: 551 - DNA, 20 bp, Artificial sequence
  Synthetic oligonucleotide
tggtgcggcaggcctggctg

SEQ ID NO: 552 - DNA, 20 bp, Artificial sequence
  Synthetic oligonucleotide
gccctccacctctaggcagc

SEQ ID NO: 553 - DNA, 20 bp, Artificial sequence
  Synthetic oligonucleotide
gcagaaggctccggtgtagc

SEQ ID NO: 554 - DNA, 20 bp, Artificial sequence
  Synthetic oligonucleotide
caggccgcggtagctgagcc

SEQ ID NO: 555 - DNA, 20 bp, Artificial sequence
  Synthetic oligonucleotide
gtggcctccgaggcccacgg

SEQ ID NO: 556 - DNA, 20 bp, Artificial sequence
  Synthetic oligonucleotide
ccaggtcgcagtactcccag

SEQ ID NO: 557 - DNA, 20 bp, Artificial sequence
  Synthetic oligonucleotide
ggcggtgccggctgcgcggg

SEQ ID NO: 558 - DNA, 20 bp, Artificial sequence
  Synthetic oligonucleotide
ggcggctgctcccgcttcgc

SEQ ID NO: 559 - DNA, 20 bp, Artificial sequence
  Synthetic oligonucleotide
cggagccgctgcccgcagct

SEQ ID NO: 560 - DNA, 20 bp, Artificial sequence
  Synthetic oligonucleotide
cccgccaacgacgcgggtca

SEQ ID NO: 561 - DNA, 20 bp, Artificial sequence
  Synthetic oligonucleotide
ctgccggcgcagaaactgtg

SEQ ID NO: 562 - DNA, 20 bp, Artificial sequence
  Synthetic oligonucleotide
ggccgagcaccaccgtcaga

SEQ ID NO: 563 - DNA, 20 bp, Artificial sequence
  Synthetic oligonucleotide
gctgacgggcgagaaggcct

SEQ ID NO: 564 - DNA, 20 bp, Artificial sequence
  Synthetic oligonucleotide
caggagcgcgcagctgccgt

SEQ ID NO: 565 - DNA, 20 bp, Artificial sequence
  Synthetic oligonucleotide
ggtggccccagccggccacc

SEQ ID NO: 566 - DNA, 20 bp, Artificial sequence
  Synthetic oligonucleotide
aagctggcatattcctccgc

SEQ ID NO: 567 - DNA, 20 bp, Artificial sequence
  Synthetic oligonucleotide
ggatggaggatccgtgcacg

SEQ ID NO: 568 - DNA, 20 bp, Artificial sequence
  Synthetic oligonucleotide
cagcttggtcctcacacacc

SEQ ID NO: 569 - DNA, 20 bp, Artificial sequence
  Synthetic oligonucleotide
gcccgatccccagctgatga

SEQ ID NO: 570 - DNA, 20 bp, Artificial sequence
  Synthetic oligonucleotide
aggaaacggtgtgctcccgg

SEQ ID NO: 571 - DNA, 20 bp, Artificial sequence
  Synthetic oligonucleotide
ctgcggaatcaccaaggagg

SEQ ID NO: 572 - DNA, 20 bp, Artificial sequence
  Synthetic oligonucleotide
cacaatcttgccttccatgc

SEQ ID NO: 573 - DNA, 20 bp, Artificial sequence
  Synthetic oligonucleotide
ttattgagttcctgcgccat

SEQ ID NO: 574 - DNA, 20 bp, Artificial sequence
  Synthetic oligonucleotide
tggttcccacagcactcacc

SEQ ID NO: 575 - DNA, 20 bp, Artificial sequence
  Synthetic oligonucleotide
agtcacctggacccacaggt

SEQ ID NO: 576 - DNA, 20 bp, Artificial sequence
  Synthetic oligonucleotide
aaatgcaggctgtgcccttg

SEQ ID NO: 577 - DNA, 20 bp, Artificial sequence
  Synthetic oligonucleotide
ttcctctcacagcccagaaa

SEQ ID NO: 578 - DNA, 20 bp, Artificial sequence
  Synthetic oligonucleotide
ttcccaaggtggaatctaca

SEQ ID NO: 579 - DNA, 20 bp, Artificial sequence
  Synthetic oligonucleotide
tagcaccaggtaggcactag

SEQ ID NO: 580 - DNA, 20 bp, Artificial sequence
  Synthetic oligonucleotide
aagcacctgctccgagccag

SEQ ID NO: 581 - DNA, 20 bp, Artificial sequence
  Synthetic oligonucleotide
ccttccttgcccattgaagg

SEQ ID NO: 582 - DNA, 20 bp, Artificial sequence
  Synthetic oligonucleotide
agcttggagaactcaaatcc

SEQ ID NO: 583 - DNA, 20 bp, Artificial sequence
  Synthetic oligonucleotide
atttccatgcaccaggtgat

SEQ ID NO: 584 - DNA, 20 bp, Artificial sequence
  Synthetic oligonucleotide
tggcatgtaggtaatttagt

SEQ ID NO: 585 - DNA, 20 bp, Artificial sequence
  Synthetic oligonucleotide
ttagagactcaaccccacca

SEQ ID NO: 586 - DNA, 20 bp, Artificial sequence
  Synthetic oligonucleotide
atgcagatgggatggacgga

SEQ ID NO: 587 - DNA, 20 bp, Artificial sequence
  Synthetic oligonucleotide
gtgcacttgccaaggaccaa

SEQ ID NO: 588 - DNA, 20 bp, Artificial sequence
  Synthetic oligonucleotide
gagaattgcctgtgtcttct

SEQ ID NO: 589 - DNA, 20 bp, Artificial sequence
  Synthetic oligonucleotide
attatatgctgttggttgat

SEQ ID NO: 590 - DNA, 20 bp, Artificial sequence
  Synthetic oligonucleotide
gctaccttagggagaaagcg

SEQ ID NO: 591 - DNA, 20 bp, Artificial sequence
  Synthetic oligonucleotide
tgagtgtccttctcagtcta

SEQ ID NO: 592 - DNA, 20 bp, Artificial sequence
  Synthetic oligonucleotide
tcatggccatttgtgggcat

SEQ ID NO: 593 - DNA, 20 bp, Artificial sequence
  Synthetic oligonucleotide
agtacagttgatcctcattc

SEQ ID NO: 594 - DNA, 20 bp, Artificial sequence
  Synthetic oligonucleotide
gagcacttgccacaaagtag

SEQ ID NO: 595 - DNA, 20 bp, Artificial sequence
  Synthetic oligonucleotide
aacttgggttcaggagtcag

SEQ ID NO: 596 - DNA, 20 bp, Artificial sequence
  Synthetic oligonucleotide
caggcactgtccctcagggt

SEQ ID NO: 597 - DNA, 20 bp, Artificial sequence
  Synthetic oligonucleotide
ggcagggtacatgtctccca

SEQ ID NO: 598 - DNA, 20 bp, Artificial sequence
  Synthetic oligonucleotide
gcacacctgtagaaagagac

SEQ ID NO: 599 - DNA, 20 bp, Artificial sequence
  Synthetic oligonucleotide
cagaatcccaggtgtgtggg

SEQ ID NO: 600 - DNA, 20 bp, Artificial sequence
  Synthetic oligonucleotide
ctccaagtttccaagcttgg

SEQ ID NO: 601 - DNA, 20 bp, Artificial sequence
  Synthetic oligonucleotide
ctgcagtggtctgagagatg

SEQ ID NO: 602 - DNA, 20 bp, Artificial sequence
  Synthetic oligonucleotide
caagtctccgagtatccagc

SEQ ID NO: 603 - DNA, 20 bp, Artificial sequence
  Synthetic oligonucleotide
ctgccagcctgtcttcctga

SEQ ID NO: 604 - DNA, 20 bp, Artificial sequence
  Synthetic oligonucleotide
cgggttggtgcggcaggctt

SEQ ID NO: 605 - DNA, 20 bp, Artificial sequence
  Synthetic oligonucleotide
ccctgggcagccaaggctgg

SEQ ID NO: 606 - DNA, 20 bp, Artificial sequence
  Synthetic oligonucleotide
ctcggctcctccttcccccc

SEQ ID NO: 607 - DNA, 20 bp, Artificial sequence
  Synthetic oligonucleotide
aagctgcgctgggagacgga

SEQ ID NO: 608 - DNA, 20 bp, Artificial sequence
  Synthetic oligonucleotide
cgcaacagagctaacccggg

SEQ ID NO: 609 - DNA, 20 bp, Artificial sequence
  Synthetic oligonucleotide
accaaagtcgcgggcttctt

SEQ ID NO: 610 - DNA, 20 bp, Artificial sequence
  Synthetic oligonucleotide
ggatcccagcagtgaatccc

SEQ ID NO: 611 - DNA, 20 bp, Artificial sequence
  Synthetic oligonucleotide
accacccatccagagtcgca

SEQ ID NO: 612 - DNA, 20 bp, Artificial sequence
  Synthetic oligonucleotide
gccattaattcaatttcata

SEQ ID NO: 613 - DNA, 20 bp, Artificial sequence
  Synthetic oligonucleotide
ccgcccctgcgaacacagag

SEQ ID NO: 614 - DNA, 20 bp, Artificial sequence
  Synthetic oligonucleotide
cttctcagcattttcaaagc

SEQ ID NO: 615 - DNA, 20 bp, Artificial sequence
  Synthetic oligonucleotide
ttccttctcagcattttcaa

SEQ ID NO: 616 - DNA, 20 bp, Artificial sequence
  Synthetic oligonucleotide
tttccttctcagcattttca

SEQ ID NO: 617 - DNA, 20 bp, Artificial sequence
  Synthetic oligonucleotide
tcatggcatccgtccgttgg

SEQ ID NO: 618 - DNA, 20 bp, Artificial sequence
  Synthetic oligonucleotide
ccttctcagcattttcaaag

SEQ ID NO: 619 - DNA, 20 bp, Artificial sequence
  Synthetic oligonucleotide
ctcatggcatccgtccgttg

SEQ ID NO: 620 - DNA, 20 bp, Artificial sequence
  Synthetic oligonucleotide
tccaggagtccagatcaata

SEQ ID NO: 621 - DNA, 20 bp, Artificial sequence
  Synthetic oligonucleotide
ccctcatggcatccgtccgt

SEQ ID NO: 622 - DNA, 20 bp, Artificial sequence
  Synthetic oligonucleotide
aagtgttgactccaagctca

SEQ ID NO: 623 - DNA, 20 bp, Artificial sequence
  Synthetic oligonucleotide
ctgtgtgctcttcagctttg

SEQ ID NO: 624 - DNA, 20 bp, Artificial sequence
  Synthetic oligonucleotide
ggaagtggcagggctccccg

SEQ ID NO: 625 - DNA, 20 bp, Artificial sequence
  Synthetic oligonucleotide
ctggccggcccttgtgggta

SEQ ID NO: 626 - DNA, 20 bp, Artificial sequence
  Synthetic oligonucleotide
caaacagtatccccatcgct

SEQ ID NO: 627 - DNA, 20 bp, Artificial sequence
  Synthetic oligonucleotide
gggctgtgtttgctgcagtg

SEQ ID NO: 628 - DNA, 20 bp, Artificial sequence
  Synthetic oligonucleotide
ccagtgaggtgttgtggaca

SEQ ID NO: 629 - DNA, 20 bp, Artificial sequence
  Synthetic oligonucleotide
gagaagctgaggctcaaagc

SEQ ID NO: 630 - DNA, 20 bp, Artificial sequence
  Synthetic oligonucleotide
tgcttgctcagttctatacc

SEQ ID NO: 631 - DNA, 20 bp, Artificial sequence
  Synthetic oligonucleotide
gttggtgcggcaggcctggc

SEQ ID NO: 632 - DNA, 20 bp, Artificial sequence
  Synthetic oligonucleotide
ggccctccacctctaggcag

SEQ ID NO: 633 - DNA, 20 bp, Artificial sequence
  Synthetic oligonucleotide
cgcagaaggctccggtgtag

SEQ ID NO: 634 - DNA, 20 bp, Artificial sequence
  Synthetic oligonucleotide
ccaggccgcggtagctgagc

SEQ ID NO: 635 - DNA, 20 bp, Artificial sequence
  Synthetic oligonucleotide
ggtggcctccgaggcccacg

SEQ ID NO: 636 - DNA, 20 bp, Artificial sequence
  Synthetic oligonucleotide
gaagcaccacgggcggatgt

SEQ ID NO: 637 - DNA, 20 bp, Artificial sequence
  Synthetic oligonucleotide
gccaggtcgcagtactccca

SEQ ID NO: 638 - DNA, 20 bp, Artificial sequence
  Synthetic oligonucleotide
cggcggtgccggctgcgcgg

SEQ ID NO: 639 - DNA, 20 bp, Artificial sequence
  Synthetic oligonucleotide
aggcggctgctcccgcttcg

SEQ ID NO: 640 - DNA, 20 bp, Artificial sequence
  Synthetic oligonucleotide
tgcggagccgctgcccgcag

SEQ ID NO: 641 - DNA, 20 bp, Artificial sequence
  Synthetic oligonucleotide
gcccgccaacgacgcgggtc

SEQ ID NO: 642 - DNA, 20 bp, Artificial sequence
  Synthetic oligonucleotide
gctgccggcgcagaaactgt

SEQ ID NO: 643 - DNA, 20 bp, Artificial sequence
  Synthetic oligonucleotide
tggccgagcaccaccgtcag

SEQ ID NO: 644 - DNA, 20 bp, Artificial sequence
  Synthetic oligonucleotide
agctgacgggcgagaaggcc

SEQ ID NO: 645 - DNA, 20 bp, Artificial sequence
  Synthetic oligonucleotide
acaggagcgcgcagctgccg

SEQ ID NO: 646 - DNA, 20 bp, Artificial sequence
  Synthetic oligonucleotide
tggtggccccagccggccac

SEQ ID NO: 647 - DNA, 20 bp, Artificial sequence
  Synthetic oligonucleotide
ggaagctggcatattcctcc

SEQ ID NO: 648 - DNA, 20 bp, Artificial sequence
  Synthetic oligonucleotide
ggaggatggaggatccgtgc

SEQ ID NO: 649 - DNA, 20 bp, Artificial sequence
  Synthetic oligonucleotide
gcagcttggtcctcacacac

SEQ ID NO: 650 - DNA, 20 bp, Artificial sequence
  Synthetic oligonucleotide
agcccgatccccagctgatg

SEQ ID NO: 651 - DNA, 20 bp, Artificial sequence
  Synthetic oligonucleotide
gtagtaggccacatcggtgt

SEQ ID NO: 652 - DNA, 20 bp, Artificial sequence
  Synthetic oligonucleotide
caggaaacggtgtgctcccg

SEQ ID NO: 653 - DNA, 20 bp, Artificial sequence
  Synthetic oligonucleotide
cactgcggaatcaccaagga

SEQ ID NO: 654 - DNA, 20 bp, Artificial sequence
  Synthetic oligonucleotide
acacaatcttgccttccatg

SEQ ID NO: 655 - DNA, 20 bp, Artificial sequence
  Synthetic oligonucleotide
tcctggttcccacagcactc

SEQ ID NO: 656 - DNA, 20 bp, Artificial sequence
  Synthetic oligonucleotide
cctagtcacctggacccaca

SEQ ID NO: 657 - DNA, 20 bp, Artificial sequence
  Synthetic oligonucleotide
cagaaatgcaggctgtgccc

SEQ ID NO: 658 - DNA, 20 bp, Artificial sequence
  Synthetic oligonucleotide
tgcagcttcctctcacagcc

SEQ ID NO: 659 - DNA, 20 bp, Artificial sequence
  Synthetic oligonucleotide
ccgactgtgtgctcttcagc

SEQ ID NO: 660 - DNA, 20 bp, Artificial sequence
  Synthetic oligonucleotide
acctagcaccaggtaggcac

SEQ ID NO: 661 - DNA, 20 bp, Artificial sequence
  Synthetic oligonucleotide
ctcaagcacctgctccgagc

SEQ ID NO: 662 - DNA, 20 bp, Artificial sequence
  Synthetic oligonucleotide
gatccttccttgcccattga

SEQ ID NO: 663 - DNA, 20 bp, Artificial sequence
  Synthetic oligonucleotide
tgaagcttggagaactcaaa

SEQ ID NO: 664 - DNA, 20 bp, Artificial sequence
  Synthetic oligonucleotide
agcatttccatgcaccaggt

SEQ ID NO: 665 - DNA, 20 bp, Artificial sequence
  Synthetic oligonucleotide
gcctggcatgtaggtaattt

SEQ ID NO: 666 - DNA, 20 bp, Artificial sequence
  Synthetic oligonucleotide
tgcttagagactcaacccca

SEQ ID NO: 667 - DNA, 20 bp, Artificial sequence
  Synthetic oligonucleotide
aagatgcagatgggatggac

SEQ ID NO: 668 - DNA, 20 bp, Artificial sequence
  Synthetic oligonucleotide
aaagtgcacttgccaaggac

SEQ ID NO: 669 - DNA, 20 bp, Artificial sequence
  Synthetic oligonucleotide
aatgagaattgcctgtgtct

SEQ ID NO: 670 - DNA, 20 bp, Artificial sequence
  Synthetic oligonucleotide
cagattatatgctgttggtt

SEQ ID NO: 671 - DNA, 20 bp, Artificial sequence
  Synthetic oligonucleotide
aaggctaccttagggagaaa

SEQ ID NO: 672 - DNA, 20 bp, Artificial sequence
  Synthetic oligonucleotide
gaatgagtgtccttctcagt

SEQ ID NO: 673 - DNA, 20 bp, Artificial sequence
  Synthetic oligonucleotide
ttttcatggccatttgtggg

SEQ ID NO: 674 - DNA, 20 bp, Artificial sequence
  Synthetic oligonucleotide
aatagtacagttgatcctca

SEQ ID NO: 675 - DNA, 20 bp, Artificial sequence
  Synthetic oligonucleotide
gaagagcacttgccacaaag

SEQ ID NO: 676 - DNA, 20 bp, Artificial sequence
  Synthetic oligonucleotide
aaaaaaaacttgggttcagg

SEQ ID NO: 677 - DNA, 20 bp, Artificial sequence
  Synthetic oligonucleotide
gctcaggcactgtccctcag

SEQ ID NO: 678 - DNA, 20 bp, Artificial sequence
  Synthetic oligonucleotide
acaggcagggtacatgtctc

SEQ ID NO: 679 - DNA, 20 bp, Artificial sequence
  Synthetic oligonucleotide
gtagcacacctgtagaaaga

SEQ ID NO: 680 - DNA, 20 bp, Artificial sequence
  Synthetic oligonucleotide
gtccagaatcccaggtgtgt

SEQ ID NO: 681 - DNA, 20 bp, Artificial sequence
  Synthetic oligonucleotide
ctactccaagtttccaagct

SEQ ID NO: 682 - DNA, 20 bp, Artificial sequence
  Synthetic oligonucleotide
ttgctgcagtggtctgagag

SEQ ID NO: 683 - DNA, 20 bp, Artificial sequence
  Synthetic oligonucleotide
tgccaagtctccgagtatcc

SEQ ID NO: 684 - DNA, 20 bp, Artificial sequence
  Synthetic oligonucleotide
ctcctgccagcctgtcttcc

SEQ ID NO: 685 - DNA, 20 bp, Artificial sequence
  Synthetic oligonucleotide
cagaccctcactcacccacg

SEQ ID NO: 686 - DNA, 20 bp, Artificial sequence
  Synthetic oligonucleotide
gctccctgggcagccaaggc

SEQ ID NO: 687 - DNA, 20 bp, Artificial sequence
  Synthetic oligonucleotide
cctctcggctcctccttccc

SEQ ID NO: 688 - DNA, 20 bp, Artificial sequence
  Synthetic oligonucleotide
tggaagctgcgctgggagac

SEQ ID NO: 689 - DNA, 20 bp, Artificial sequence
  Synthetic oligonucleotide
aggcgcaacagagctaaccc

SEQ ID NO: 690 - DNA, 20 bp, Artificial sequence
  Synthetic oligonucleotide
gataccaaagtcgcgggctt

SEQ ID NO: 691 - DNA, 20 bp, Artificial sequence
  Synthetic oligonucleotide
gtatccccaggagatttggg

SEQ ID NO: 692 - DNA, 20 bp, Artificial sequence
  Synthetic oligonucleotide
cccaccacccatccagagtc

SEQ ID NO: 693 - DNA, 20 bp, Artificial sequence
  Synthetic oligonucleotide
ggtgccattaattcaatttc

SEQ ID NO: 694 - DNA, 20 bp, Artificial sequence
  Synthetic oligonucleotide
cctccgcccctgcgaacaca

SEQ ID NO: 695 - DNA, 20 bp, Artificial sequence
  Synthetic oligonucleotide
atccaggagtccagatcaat

SEQ ID NO: 696 - DNA, 20 bp, Artificial sequence
  Synthetic oligonucleotide
gccctcatggcatccgtccg

SEQ ID NO: 697 - DNA, 20 bp, Artificial sequence
  Synthetic oligonucleotide
aaagtgttgactccaagctc

SEQ ID NO: 698 - DNA, 20 bp, Artificial sequence
  Synthetic oligonucleotide
gactgtgtgctcttcagctt

SEQ ID NO: 699 - DNA, 20 bp, Artificial sequence
  Synthetic oligonucleotide
tgccggtggtactggaaggg

SEQ ID NO: 700 - DNA, 20 bp, Artificial sequence
  Synthetic oligonucleotide
cctggccggcccttgtgggt

SEQ ID NO: 701 - DNA, 20 bp, Artificial sequence
  Synthetic oligonucleotide
ccaaacagtatccccatcgc

SEQ ID NO: 702 - DNA, 20 bp, Artificial sequence
  Synthetic oligonucleotide
ggtccctcctttctggcagg

SEQ ID NO: 703 - DNA, 20 bp, Artificial sequence
  Synthetic oligonucleotide
tccagtgaggtgttgtggac

SEQ ID NO: 704 - DNA, 20 bp, Artificial sequence
  Synthetic oligonucleotide
ccggagaagctgaggctcaa

SEQ ID NO: 705 - DNA, 20 bp, Artificial sequence
  Synthetic oligonucleotide
ctgcttgctcagttctatac

SEQ ID NO: 706 - DNA, 20 bp, Artificial sequence
  Synthetic oligonucleotide
cagtgggcatcaggaccctt

SEQ ID NO: 707 - DNA, 20 bp, Artificial sequence
  Synthetic oligonucleotide
ggttggtgcggcaggcctgg

SEQ ID NO: 708 - DNA, 20 bp, Artificial sequence
  Synthetic oligonucleotide
gtggccctccacctctaggc

SEQ ID NO: 709 - DNA, 20 bp, Artificial sequence
  Synthetic oligonucleotide
gtcgcagaaggctccggtgt

SEQ ID NO: 710 - DNA, 20 bp, Artificial sequence
  Synthetic oligonucleotide
gccaggccgcggtagctgag

SEQ ID NO: 711 - DNA, 20 bp, Artificial sequence
  Synthetic oligonucleotide
ggtaggtggcctccgaggcc

SEQ ID NO: 712 - DNA, 20 bp, Artificial sequence
  Synthetic oligonucleotide
cgaagcaccacgggcggatg

SEQ ID NO: 713 - DNA, 20 bp, Artificial sequence
  Synthetic oligonucleotide
tgccaggtcgcagtactccc

SEQ ID NO: 714 - DNA, 20 bp, Artificial sequence
  Synthetic oligonucleotide
tcggcggtgccggctgcgcg

SEQ ID NO: 715 - DNA, 20 bp, Artificial sequence
  Synthetic oligonucleotide
aaggcggctgctcccgcttc

SEQ ID NO: 716 - DNA, 20 bp, Artificial sequence
  Synthetic oligonucleotide
ttgcggagccgctgcccgca

SEQ ID NO: 717 - DNA, 20 bp, Artificial sequence
  Synthetic oligonucleotide
cagcccgccaacgacgcggg

SEQ ID NO: 718 - DNA, 20 bp, Artificial sequence
  Synthetic oligonucleotide
aggctgccggcgcagaaact

SEQ ID NO: 719 - DNA, 20 bp, Artificial sequence
  Synthetic oligonucleotide
ctggccgagcaccaccgtca

SEQ ID NO: 720 - DNA, 20 bp, Artificial sequence
  Synthetic oligonucleotide
ggtagctgacgggcgagaag

SEQ ID NO: 721 - DNA, 20 bp, Artificial sequence
  Synthetic oligonucleotide
cgacaggagcgcgcagctgc

SEQ ID NO: 722 - DNA, 20 bp, Artificial sequence
  Synthetic oligonucleotide
ctggtggccccagccggcca

SEQ ID NO: 723 - DNA, 20 bp, Artificial sequence
  Synthetic oligonucleotide
aggaagctggcatattcctc

SEQ ID NO: 724 - DNA, 20 bp, Artificial sequence
  Synthetic oligonucleotide
tgcagcttggtcctcacaca

SEQ ID NO: 725 - DNA, 20 bp, Artificial sequence
  Synthetic oligonucleotide
cagcccgatccccagctgat

SEQ ID NO: 726 - DNA, 20 bp, Artificial sequence
  Synthetic oligonucleotide
ggtagtaggccacatcggtg

SEQ ID NO: 727 - DNA, 20 bp, Artificial sequence
  Synthetic oligonucleotide
tcaggaaacggtgtgctccc

SEQ ID NO: 728 - DNA, 20 bp, Artificial sequence
  Synthetic oligonucleotide
tcactgcggaatcaccaagg

SEQ ID NO: 729 - DNA, 20 bp, Artificial sequence
  Synthetic oligonucleotide
ggacacaatcttgccttcca

SEQ ID NO: 730 - DNA, 20 bp, Artificial sequence
  Synthetic oligonucleotide
caatcctggttcccacagca

SEQ ID NO: 731 - DNA, 20 bp, Artificial sequence
  Synthetic oligonucleotide
cctcctagtcacctggaccc

SEQ ID NO: 732 - DNA, 20 bp, Artificial sequence
  Synthetic oligonucleotide
ccccagaaatgcaggctgtg

SEQ ID NO: 733 - DNA, 20 bp, Artificial sequence
  Synthetic oligonucleotide
gtctgcagcttcctctcaca

SEQ ID NO: 734 - DNA, 20 bp, Artificial sequence
  Synthetic oligonucleotide
ttaccgactgtgtgctcttc

SEQ ID NO: 735 - DNA, 20 bp, Artificial sequence
  Synthetic oligonucleotide
aagacctagcaccaggtagg

SEQ ID NO: 736 - DNA, 20 bp, Artificial sequence
  Synthetic oligonucleotide
tatctcaagcacctgctccg

SEQ ID NO: 737 - DNA, 20 bp, Artificial sequence
  Synthetic oligonucleotide
cttgatccttccttgcccat

SEQ ID NO: 738 - DNA, 20 bp, Artificial sequence
  Synthetic oligonucleotide
aattgaagcttggagaactc

SEQ ID NO: 739 - DNA, 20 bp, Artificial sequence
  Synthetic oligonucleotide
taaagcatttccatgcacca

SEQ ID NO: 740 - DNA, 20 bp, Artificial sequence
  Synthetic oligonucleotide
catgcctggcatgtaggtaa

SEQ ID NO: 741 - DNA, 20 bp, Artificial sequence
  Synthetic oligonucleotide
ccatgcttagagactcaacc

SEQ ID NO: 742 - DNA, 20 bp, Artificial sequence
  Synthetic oligonucleotide
aaaaagatgcagatgggatg

SEQ ID NO: 743 - DNA, 20 bp, Artificial sequence
  Synthetic oligonucleotide
ggcaaagtgcacttgccaag

SEQ ID NO: 744 - DNA, 20 bp, Artificial sequence
  Synthetic oligonucleotide
aataatgagaattgcctgtg

SEQ ID NO: 745 - DNA, 20 bp, Artificial sequence
  Synthetic oligonucleotide
aaccagattatatgctgttg

SEQ ID NO: 746 - DNA, 20 bp, Artificial sequence
  Synthetic oligonucleotide
aagaaggctaccttagggag

SEQ ID NO: 747 - DNA, 20 bp, Artificial sequence
  Synthetic oligonucleotide
attgaatgagtgtccttctc

SEQ ID NO: 748 - DNA, 20 bp, Artificial sequence
  Synthetic oligonucleotide
atgttttcatggccatttgt

SEQ ID NO: 749 - DNA, 20 bp, Artificial sequence
  Synthetic oligonucleotide
aataatagtacagttgatcc

SEQ ID NO: 750 - DNA, 20 bp, Artificial sequence
  Synthetic oligonucleotide
caggaagagcacttgccaca

SEQ ID NO: 751 - DNA, 20 bp, Artificial sequence
  Synthetic oligonucleotide
ctctaaaagttgggttcagg

SEQ ID NO: 752 - DNA, 20 bp, Artificial sequence
  Synthetic oligonucleotide
tcaactgctcaggcactgtc

SEQ ID NO: 753 - DNA, 20 bp, Artificial sequence
  Synthetic oligonucleotide
aggacaggcagggtacatgt

SEQ ID NO: 754 - DNA, 20 bp, Artificial sequence
  Synthetic oligonucleotide
gtggtagcacacctgtagaa

SEQ ID NO: 755 - DNA, 20 bp, Artificial sequence
  Synthetic oligonucleotide
tgggtccagaatcccaggtg

SEQ ID NO: 756 - DNA, 20 bp, Artificial sequence
  Synthetic oligonucleotide
ttgctactccaagtttccaa

SEQ ID NO: 757 - DNA, 20 bp, Artificial sequence
  Synthetic oligonucleotide
tgtttgctgcagtggtctga

SEQ ID NO: 758 - DNA, 20 bp, Artificial sequence
  Synthetic oligonucleotide
ggaccatgccaagtctccga

SEQ ID NO: 759 - DNA, 20 bp, Artificial sequence
  Synthetic oligonucleotide
ggcctcctgccagcctgtct

SEQ ID NO: 760 - DNA, 20 bp, Artificial sequence
  Synthetic oligonucleotide
ccccagaccctcactcaccc

SEQ ID NO: 761 - DNA, 20 bp, Artificial sequence
  Synthetic oligonucleotide
tggtgtctgaggagaaaggg

SEQ ID NO: 762 - DNA, 20 bp, Artificial sequence
  Synthetic oligonucleotide
cgccctctcggctcctcctt

SEQ ID NO: 763 - DNA, 20 bp, Artificial sequence
  Synthetic oligonucleotide
ctccccgggagctccggagg

SEQ ID NO: 764 - DNA, 20 bp, Artificial sequence
  Synthetic oligonucleotide
tgaaggcgcaacagagctaa

SEQ ID NO: 765 - DNA, 20 bp, Artificial sequence
  Synthetic oligonucleotide
cggaacgataccaaagtcgc

SEQ ID NO: 766 - DNA, 20 bp, Artificial sequence
  Synthetic oligonucleotide
cctgtatccccaggagattt

SEQ ID NO: 767 - DNA, 20 bp, Artificial sequence
  Synthetic oligonucleotide
tcccccaccacccatccaga

SEQ ID NO: 768 - DNA, 20 bp, Artificial sequence
  Synthetic oligonucleotide
ggaggtgccattaattcaat

SEQ ID NO: 769 - DNA, 20 bp, Artificial sequence
  Synthetic oligonucleotide
attcctccgcccctgcgaac

SEQ ID NO: 770 - DNA, 20 bp, Artificial sequence
  Synthetic oligonucleotide
atcgaaagtgttgactccaa

SEQ ID NO: 771 - DNA, 20 bp, Artificial sequence
  Synthetic oligonucleotide
cgactgtgtgctcttcagct

SEQ ID NO: 772 - DNA, 20 bp, Artificial sequence
  Synthetic oligonucleotide
gctgccggtggtactggaag

SEQ ID NO: 773 - DNA, 20 bp, Artificial sequence
  Synthetic oligonucleotide
gcctggccggcccttgtggg

SEQ ID NO: 774 - DNA, 20 bp, Artificial sequence
  Synthetic oligonucleotide
tgggctccaaacagtatccc

SEQ ID NO: 775 - DNA, 20 bp, Artificial sequence
  Synthetic oligonucleotide
caggtccctcctttctggca

SEQ ID NO: 776 - DNA, 20 bp, Artificial sequence
  Synthetic oligonucleotide
tttccagtgaggtgttgtgg

SEQ ID NO: 777 - DNA, 20 bp, Artificial sequence
  Synthetic oligonucleotide
accggagaagctgaggctca

SEQ ID NO: 778 - DNA, 20 bp, Artificial sequence
  Synthetic oligonucleotide
gctgcttgctcagttctata

SEQ ID NO: 779 - DNA, 20 bp, Artificial sequence
  Synthetic oligonucleotide
gcagtgggcatcaggaccct

SEQ ID NO: 780 - DNA, 20 bp, Artificial sequence
  Synthetic oligonucleotide
cgggttggtgcggcaggcct

SEQ ID NO: 781 - DNA, 20 bp, Artificial sequence
  Synthetic oligonucleotide
ggtggccctccacctctagg

SEQ ID NO: 782 - DNA, 20 bp, Artificial sequence
  Synthetic oligonucleotide
cgtcgcagaaggctccggtg

SEQ ID NO: 783 - DNA, 20 bp, Artificial sequence
  Synthetic oligonucleotide
ggccaggccgcggtagctga

SEQ ID NO: 784 - DNA, 20 bp, Artificial sequence
  Synthetic oligonucleotide
cggtaggtggcctccgaggc

SEQ ID NO: 785 - DNA, 20 bp, Artificial sequence
  Synthetic oligonucleotide
cacgaagcaccacgggcgga

SEQ ID NO: 786 - DNA, 20 bp, Artificial sequence
  Synthetic oligonucleotide
tgtgccaggtcgcagtactc

SEQ ID NO: 787 - DNA, 20 bp, Artificial sequence
  Synthetic oligonucleotide
ttcggcggtgccggctgcgc

SEQ ID NO: 788 - DNA, 20 bp, Artificial sequence
  Synthetic oligonucleotide
gaaggcggctgctcccgctt

SEQ ID NO: 789 - DNA, 20 bp, Artificial sequence
  Synthetic oligonucleotide
tcttgcggagccgctgcccg

SEQ ID NO: 790 - DNA, 20 bp, Artificial sequence
  Synthetic oligonucleotide
ccagcccgccaacgacgcgg

SEQ ID NO: 791 - DNA, 20 bp, Artificial sequence
  Synthetic oligonucleotide
gaggctgccggcgcagaaac

SEQ ID NO: 792 - DNA, 20 bp, Artificial sequence
  Synthetic oligonucleotide
cctggccgagcaccaccgtc

SEQ ID NO: 793 - DNA, 20 bp, Artificial sequence
  Synthetic oligonucleotide
gctggtagctgacgggcgag

SEQ ID NO: 794 - DNA, 20 bp, Artificial sequence
  Synthetic oligonucleotide
gcgacaggagcgcgcagctg

SEQ ID NO: 795 - DNA, 20 bp, Artificial sequence
  Synthetic oligonucleotide
actggtggccccagccggcc

SEQ ID NO: 796 - DNA, 20 bp, Artificial sequence
  Synthetic oligonucleotide
caggaagctggcatattcct

SEQ ID NO: 797 - DNA, 20 bp, Artificial sequence
  Synthetic oligonucleotide
ccctgcgcagagcatgccgg

SEQ ID NO: 798 - DNA, 20 bp, Artificial sequence
  Synthetic oligonucleotide
ctgcagcttggtcctcacac

SEQ ID NO: 799 - DNA, 20 bp, Artificial sequence
  Synthetic oligonucleotide
acagcccgatccccagctga

SEQ ID NO: 800 - DNA, 20 bp, Artificial sequence
  Synthetic oligonucleotide
aggtagtaggccacatcggt

SEQ ID NO: 801 - DNA, 20 bp, Artificial sequence
  Synthetic oligonucleotide
atcaggaaacggtgtgctcc

SEQ ID NO: 802 - DNA, 20 bp, Artificial sequence
  Synthetic oligonucleotide
ctcactgcggaatcaccaag

SEQ ID NO: 803 - DNA, 20 bp, Artificial sequence
  Synthetic oligonucleotide
tgggacacaatcttgccttc

SEQ ID NO: 804 - DNA, 20 bp, Artificial sequence
  Synthetic oligonucleotide
ggacaatcctggttcccaca

SEQ ID NO: 805 - DNA, 20 bp, Artificial sequence
  Synthetic oligonucleotide
aggcctcctagtcacctgga

SEQ ID NO: 806 - DNA, 20 bp, Artificial sequence
  Synthetic oligonucleotide
ggcccatctcccccagaaat

SEQ ID NO: 807 - DNA, 20 bp, Artificial sequence
  Synthetic oligonucleotide
ctagtctgcagcttcctctc

SEQ ID NO: 808 - DNA, 20 bp, Artificial sequence
  Synthetic oligonucleotide
cacttaccgactgtgtgctc

SEQ ID NO: 809 - DNA, 20 bp, Artificial sequence
  Synthetic oligonucleotide
gggcataagacctagcacca

SEQ ID NO: 810 - DNA, 20 bp, Artificial sequence
  Synthetic oligonucleotide
acatatctcaagcacctgct

SEQ ID NO: 811 - DNA, 20 bp, Artificial sequence
  Synthetic oligonucleotide
gctcttgatccttccttgcc

SEQ ID NO: 812 - DNA, 20 bp, Artificial sequence
  Synthetic oligonucleotide
aacctggtttcacagaaggg

SEQ ID NO: 813 - DNA, 20 bp, Artificial sequence
  Synthetic oligonucleotide
ttgtaaagcatttccatgca

SEQ ID NO: 814 - DNA, 20 bp, Artificial sequence
  Synthetic oligonucleotide
actctaggtaaatttttttt

SEQ ID NO: 815 - DNA, 20 bp, Artificial sequence
  Synthetic oligonucleotide
aatgtgctgggcctcaacgc

SEQ ID NO: 816 - DNA, 20 bp, Artificial sequence
  Synthetic oligonucleotide
aagttgtgtgcctgtaatcc

SEQ ID NO: 817 - DNA, 20 bp, Artificial sequence
  Synthetic oligonucleotide
caaggcaaagtgcacttgcc

SEQ ID NO: 818 - DNA, 20 bp, Artificial sequence
  Synthetic oligonucleotide
gcgaataatgagaattgcct

SEQ ID NO: 819 - DNA, 20 bp, Artificial sequence
  Synthetic oligonucleotide
taaaaccagattatatgctg

SEQ ID NO: 820 - DNA, 20 bp, Artificial sequence
  Synthetic oligonucleotide
cacaagaaggctaccttagg

SEQ ID NO: 821 - DNA, 20 bp, Artificial sequence
  Synthetic oligonucleotide
cctattgaatgagtgtcctt

SEQ ID NO: 822 - DNA, 20 bp, Artificial sequence
  Synthetic oligonucleotide
cttgaaatgttttcatggcc

SEQ ID NO: 823 - DNA, 20 bp, Artificial sequence
  Synthetic oligonucleotide
agtaataatagtacagttga

SEQ ID NO: 824 - DNA, 20 bp, Artificial sequence
  Synthetic oligonucleotide
ggccaggaagagcacttgcc

SEQ ID NO: 825 - DNA, 20 bp, Artificial sequence
  Synthetic oligonucleotide
ctgctctaaaagttgggttc

SEQ ID NO: 826 - DNA, 20 bp, Artificial sequence
  Synthetic oligonucleotide
tactcaactgctcaggcact

SEQ ID NO: 827 - DNA, 20 bp, Artificial sequence
  Synthetic oligonucleotide
agaaggacaggcagggtaca

SEQ ID NO: 828 - DNA, 20 bp, Artificial sequence
  Synthetic oligonucleotide
cctttcactttcttgggctc

SEQ ID NO: 829 - DNA, 20 bp, Artificial sequence
  Synthetic oligonucleotide
ggctgggtccagaatcccag

SEQ ID NO: 830 - DNA, 20 bp, Artificial sequence
  Synthetic oligonucleotide
accttgctactccaagtttc

SEQ ID NO: 831 - DNA, 20 bp, Artificial sequence
  Synthetic oligonucleotide
cctttctggcagtggtttcc

SEQ ID NO: 832 - DNA, 20 bp, Artificial sequence
  Synthetic oligonucleotide
ctaggaccatgccaagtctc

SEQ ID NO: 833 - DNA, 20 bp, Artificial sequence
  Synthetic oligonucleotide
cccggcctcctgccagcctg

SEQ ID NO: 834 - DNA, 20 bp, Artificial sequence
  Synthetic oligonucleotide
ttgccccagaccctcactca

SEQ ID NO: 835 - DNA, 20 bp, Artificial sequence
  Synthetic oligonucleotide
ccttggtgtctgaggagaaa

SEQ ID NO: 836 - DNA, 20 bp, Artificial sequence
  Synthetic oligonucleotide
gaatctagctcgcccggcgc

SEQ ID NO: 837 - DNA, 20 bp, Artificial sequence
  Synthetic oligonucleotide
ttcctccccgggagctccgg

SEQ ID NO: 838 - DNA, 20 bp, Artificial sequence
  Synthetic oligonucleotide
accctcgaactggtggcccc

SEQ ID NO: 839 - DNA, 20 bp, Artificial sequence
  Synthetic oligonucleotide
acccggaacgataccaaagt

SEQ ID NO: 840 - DNA, 20 bp, Artificial sequence
  Synthetic oligonucleotide
ctccctgtatccccaggaga

SEQ ID NO: 841 - DNA, 20 bp, Artificial sequence
  Synthetic oligonucleotide
cccctcccccaccacccatc

SEQ ID NO: 842 - DNA, 20 bp, Artificial sequence
  Synthetic oligonucleotide
ggaggaggtgccattaattc

SEQ ID NO: 843 - DNA, 20 bp, Artificial sequence
  Synthetic oligonucleotide
catattcctccgcccctgcg

SEQ ID NO: 844 - DNA, 20 bp, Artificial sequence
  Synthetic oligonucleotide
ctatccaggagtccagatca

SEQ ID NO: 845 - DNA, 20 bp, Artificial sequence
  Synthetic oligonucleotide
cagagccctcatggcatccg

SEQ ID NO: 846 - DNA, 20 bp, Artificial sequence
  Synthetic oligonucleotide
aatcgaaagtgttgactcca

SEQ ID NO: 847 - DNA, 20 bp, Artificial sequence
  Synthetic oligonucleotide
agctgccggtggtactggaa

SEQ ID NO: 848 - DNA, 20 bp, Artificial sequence
  Synthetic oligonucleotide
ggcctggccggcccttgtgg

SEQ ID NO: 849 - DNA, 20 bp, Artificial sequence
  Synthetic oligonucleotide
ttgggctccaaacagtatcc

SEQ ID NO: 850 - DNA, 20 bp, Artificial sequence
  Synthetic oligonucleotide
cacaggtccctcctttctgg

SEQ ID NO: 851 - DNA, 20 bp, Artificial sequence
  Synthetic oligonucleotide
gtggtttccagtgaggtgtt

SEQ ID NO: 852 - DNA, 20 bp, Artificial sequence
  Synthetic oligonucleotide
aaaccggagaagctgaggct

SEQ ID NO: 853 - DNA, 20 bp, Artificial sequence
  Synthetic oligonucleotide
agctgcttgctcagttctat

SEQ ID NO: 854 - DNA, 20 bp, Artificial sequence
  Synthetic oligonucleotide
tggcagtgggcatcaggacc

SEQ ID NO: 855 - DNA, 20 bp, Artificial sequence
  Synthetic oligonucleotide
acgggttggtgcggcaggcc

SEQ ID NO: 856 - DNA, 20 bp, Artificial sequence
  Synthetic oligonucleotide
cggtggccctccacctctag

SEQ ID NO: 857 - DNA, 20 bp, Artificial sequence
  Synthetic oligonucleotide
agcttgccttggtgtccacg

SEQ ID NO: 858 - DNA, 20 bp, Artificial sequence
  Synthetic oligonucleotide
ctggccaggccgcggtagct

SEQ ID NO: 859 - DNA, 20 bp, Artificial sequence
  Synthetic oligonucleotide
ccggtaggtggcctccgagg

SEQ ID NO: 860 - DNA, 20 bp, Artificial sequence
  Synthetic oligonucleotide
gcacgaagcaccacgggcgg

SEQ ID NO: 861 - DNA, 20 bp, Artificial sequence
  Synthetic oligonucleotide
ctgtgccaggtcgcagtact

SEQ ID NO: 862 - DNA, 20 bp, Artificial sequence
  Synthetic oligonucleotide
gcttcggcggtgccggctgc

SEQ ID NO: 863 - DNA, 20 bp, Artificial sequence
  Synthetic oligonucleotide
ggaaggcggctgctcccgct

SEQ ID NO: 864 - DNA, 20 bp, Artificial sequence
  Synthetic oligonucleotide
ctcttgcggagccgctgccc

SEQ ID NO: 865 - DNA, 20 bp, Artificial sequence
  Synthetic oligonucleotide
caccagcccgccaacgacgc

SEQ ID NO: 866 - DNA, 20 bp, Artificial sequence
  Synthetic oligonucleotide
tgaggctgccggcgcagaaa

SEQ ID NO: 867 - DNA, 20 bp, Artificial sequence
  Synthetic oligonucleotide
tcctggccgagcaccaccgt

SEQ ID NO: 868 - DNA, 20 bp, Artificial sequence
  Synthetic oligonucleotide
gtgctggtagctgacgggcg

SEQ ID NO: 869 - DNA, 20 bp, Artificial sequence
  Synthetic oligonucleotide
aggcgacaggagcgcgcagc

SEQ ID NO: 870 - DNA, 20 bp, Artificial sequence
  Synthetic oligonucleotide
aactggtggccccagccggc

SEQ ID NO: 871 - DNA, 20 bp, Artificial sequence
  Synthetic oligonucleotide
gcaggaagctggcatattcc

SEQ ID NO: 872 - DNA, 20 bp, Artificial sequence
  Synthetic oligonucleotide
accctgcgcagagcatgccg

SEQ ID NO: 873 - DNA, 20 bp, Artificial sequence
  Synthetic oligonucleotide
ctctgcagcttggtcctcac

SEQ ID NO: 874 - DNA, 20 bp, Artificial sequence
  Synthetic oligonucleotide
cacagcccgatccccagctg

SEQ ID NO: 875 - DNA, 20 bp, Artificial sequence
  Synthetic oligonucleotide
caggtagtaggccacatcgg

SEQ ID NO: 876 - DNA, 20 bp, Artificial sequence
  Synthetic oligonucleotide
caatcaggaaacggtgtgct

SEQ ID NO: 877 - DNA, 20 bp, Artificial sequence
  Synthetic oligonucleotide
tctcactgcggaatcaccaa

SEQ ID NO: 878 - DNA, 20 bp, Artificial sequence
  Synthetic oligonucleotide
atgggacacaatcttgcctt

SEQ ID NO: 879 - DNA, 20 bp, Artificial sequence
  Synthetic oligonucleotide
ctgggacaatcctggttccc

SEQ ID NO: 880 - DNA, 20 bp, Artificial sequence
  Synthetic oligonucleotide
cataggcctcctagtcacct

SEQ ID NO: 881 - DNA, 20 bp, Artificial sequence
  Synthetic oligonucleotide
taaggcccatctcccccaga

SEQ ID NO: 882 - DNA, 20 bp, Artificial sequence
  Synthetic oligonucleotide
ttgctagtctgcagcttcct

SEQ ID NO: 883 - DNA, 20 bp, Artificial sequence
  Synthetic oligonucleotide
aggccacttaccgactgtgt

SEQ ID NO: 884 - DNA, 20 bp, Artificial sequence
  Synthetic oligonucleotide
catgggcataagacctagca

SEQ ID NO: 885 - DNA, 20 bp, Artificial sequence
  Synthetic oligonucleotide
agcacatatctcaagcacct

SEQ ID NO: 886 - DNA, 20 bp, Artificial sequence
  Synthetic oligonucleotide
agacaagctcttgatccttc

SEQ ID NO: 887 - DNA, 20 bp, Artificial sequence
  Synthetic oligonucleotide
atcaacctggtttcacagaa

SEQ ID NO: 888 - DNA, 20 bp, Artificial sequence
  Synthetic oligonucleotide
tatttgtaaagcatttccat

SEQ ID NO: 889 - DNA, 20 bp, Artificial sequence
  Synthetic oligonucleotide
cacactctaggtaaattttt

SEQ ID NO: 890 - DNA, 20 bp, Artificial sequence
  Synthetic oligonucleotide
tggaatgtgctgggcctcaa

SEQ ID NO: 891 - DNA, 20 bp, Artificial sequence
  Synthetic oligonucleotide
atgaagttgtgtgcctgtaa

SEQ ID NO: 892 - DNA, 20 bp, Artificial sequence
  Synthetic oligonucleotide
gttcaaggcaaagtgcactt

SEQ ID NO: 893 - DNA, 20 bp, Artificial sequence
  Synthetic oligonucleotide
atcgcgaataatgagaattg

SEQ ID NO: 894 - DNA, 20 bp, Artificial sequence
  Synthetic oligonucleotide
acataaaaccagattatatg

SEQ ID NO: 895 - DNA, 20 bp, Artificial sequence
  Synthetic oligonucleotide
aagcacaagaaggctacctt

SEQ ID NO: 896 - DNA, 20 bp, Artificial sequence
  Synthetic oligonucleotide
tctcctattgaatgagtgtc

SEQ ID NO: 897 - DNA, 20 bp, Artificial sequence
  Synthetic oligonucleotide
caatacttgaaatgttttca

SEQ ID NO: 898 - DNA, 20 bp, Artificial sequence
  Synthetic oligonucleotide
ggcagtaataatagtacagt

SEQ ID NO: 899 - DNA, 20 bp, Artificial sequence
  Synthetic oligonucleotide
caaggccaggaagagcactt

SEQ ID NO: 900 - DNA, 20 bp, Artificial sequence
  Synthetic oligonucleotide
tttctgctctaaaagttggg

SEQ ID NO: 901 - DNA, 20 bp, Artificial sequence
  Synthetic oligonucleotide
ctgtactcaactgctcaggc

SEQ ID NO: 902 - DNA, 20 bp, Artificial sequence
  Synthetic oligonucleotide
gacagaaggacaggcagggt

SEQ ID NO: 903 - DNA, 20 bp, Artificial sequence
  Synthetic oligonucleotide
gcacctttcactttcttggg

SEQ ID NO: 904 - DNA, 20 bp, Artificial sequence
  Synthetic oligonucleotide
tattgtggagggagagaagg

SEQ ID NO: 905 - DNA, 20 bp, Artificial sequence
  Synthetic oligonucleotide
gtgaccttgctactccaagt

SEQ ID NO: 906 - DNA, 20 bp, Artificial sequence
  Synthetic oligonucleotide
tcacctttctggcagtggtt

SEQ ID NO: 907 - DNA, 20 bp, Artificial sequence
  Synthetic oligonucleotide
agtctaggaccatgccaagt

SEQ ID NO: 908 - DNA, 20 bp, Artificial sequence
  Synthetic oligonucleotide
ccacccggcctcctgccagc

SEQ ID NO: 909 - DNA, 20 bp, Artificial sequence
  Synthetic oligonucleotide
tgcttgccccagaccctcac

SEQ ID NO: 910 - DNA, 20 bp, Artificial sequence
  Synthetic oligonucleotide
ttgccttggtgtctgaggag

SEQ ID NO: 911 - DNA, 20 bp, Artificial sequence
  Synthetic oligonucleotide
ccggaatctagctcgcccgg

SEQ ID NO: 912 - DNA, 20 bp, Artificial sequence
  Synthetic oligonucleotide
agcttcctccccgggagctc

SEQ ID NO: 913 - DNA, 20 bp, Artificial sequence
  Synthetic oligonucleotide
cctaccctcgaactggtggc

SEQ ID NO: 914 - DNA, 20 bp, Artificial sequence
  Synthetic oligonucleotide
ggcacccggaacgataccaa

SEQ ID NO: 915 - DNA, 20 bp, Artificial sequence
  Synthetic oligonucleotide
attctccctgtatccccagg

SEQ ID NO: 916 - DNA, 20 bp, Artificial sequence
  Synthetic oligonucleotide
aaacccctcccccaccaccc

SEQ ID NO: 917 - DNA, 20 bp, Artificial sequence
  Synthetic oligonucleotide
ctcgcagcaagcccgaaggg

SEQ ID NO: 918 - DNA, 20 bp, Artificial sequence
  Synthetic oligonucleotide
tggcatattcctccgcccct

SEQ ID NO: 919 - DNA, 20 bp, Artificial sequence
  Synthetic oligonucleotide
gcctatccaggagtccagat

SEQ ID NO: 920 - DNA, 20 bp, Artificial sequence
  Synthetic oligonucleotide
gcagcagagccctcatggca

SEQ ID NO: 921 - DNA, 20 bp, Artificial sequence
  Synthetic oligonucleotide
gaatcgaaagtgttgactcc

SEQ ID NO: 922 - DNA, 20 bp, Artificial sequence
  Synthetic oligonucleotide
aacgactgtgtgctcttcag

SEQ ID NO: 923 - DNA, 20 bp, Artificial sequence
  Synthetic oligonucleotide
cagctgccggtggtactgga

SEQ ID NO: 924 - DNA, 20 bp, Artificial sequence
  Synthetic oligonucleotide
gggcctggccggcccttgtg

SEQ ID NO: 925 - DNA, 20 bp, Artificial sequence
  Synthetic oligonucleotide
cttgggctccaaacagtatc

SEQ ID NO: 926 - DNA, 20 bp, Artificial sequence
  Synthetic oligonucleotide
acacaggtccctcctttctg

SEQ ID NO: 927 - DNA, 20 bp, Artificial sequence
  Synthetic oligonucleotide
cagtggtttccagtgaggtg

SEQ ID NO: 928 - DNA, 20 bp, Artificial sequence
  Synthetic oligonucleotide
aaaaccggagaagctgaggc

SEQ ID NO: 929 - DNA, 20 bp, Artificial sequence
  Synthetic oligonucleotide
cagctgcttgctcagttcta

SEQ ID NO: 930 - DNA, 20 bp, Artificial sequence
  Synthetic oligonucleotide
ctggcagtgggcatcaggac

SEQ ID NO: 931 - DNA, 20 bp, Artificial sequence
  Synthetic oligonucleotide
gcacgggttggtgcggcagg

SEQ ID NO: 932 - DNA, 20 bp, Artificial sequence
  Synthetic oligonucleotide
gcggtggccctccacctcta

SEQ ID NO: 933 - DNA, 20 bp, Artificial sequence
  Synthetic oligonucleotide
cagcttgccttggtgtccac

SEQ ID NO: 934 - DNA, 20 bp, Artificial sequence
  Synthetic oligonucleotide
cctggccaggccgcggtagc

SEQ ID NO: 935 - DNA, 20 bp, Artificial sequence
  Synthetic oligonucleotide
tccggtaggtggcctccgag

SEQ ID NO: 936 - DNA, 20 bp, Artificial sequence
  Synthetic oligonucleotide
agcacgaagcaccacgggcg

SEQ ID NO: 937 - DNA, 20 bp, Artificial sequence
  Synthetic oligonucleotide
actgtgccaggtcgcagtac

SEQ ID NO: 938 - DNA, 20 bp, Artificial sequence
  Synthetic oligonucleotide
ggcttcggcggtgccggctg

SEQ ID NO: 939 - DNA, 20 bp, Artificial sequence
  Synthetic oligonucleotide
gggaaggcggctgctcccgc

SEQ ID NO: 940 - DNA, 20 bp, Artificial sequence
  Synthetic oligonucleotide
ccaccagcccgccaacgacg

SEQ ID NO: 941 - DNA, 20 bp, Artificial sequence
  Synthetic oligonucleotide
atgaggctgccggcgcagaa

SEQ ID NO: 942 - DNA, 20 bp, Artificial sequence
  Synthetic oligonucleotide
ttcctggccgagcaccaccg

SEQ ID NO: 943 - DNA, 20 bp, Artificial sequence
  Synthetic oligonucleotide
cgtgctggtagctgacgggc

SEQ ID NO: 944 - DNA, 20 bp, Artificial sequence
  Synthetic oligonucleotide
aaggcgacaggagcgcgcag

SEQ ID NO: 945 - DNA, 20 bp, Artificial sequence
  Synthetic oligonucleotide
gaactggtggccccagccgg

SEQ ID NO: 946 - DNA, 20 bp, Artificial sequence
  Synthetic oligonucleotide
tcctgcaggaagctggcata

SEQ ID NO: 947 - DNA, 20 bp, Artificial sequence
  Synthetic oligonucleotide
gaaccctgcgcagagcatgc

SEQ ID NO: 948 - DNA, 20 bp, Artificial sequence
  Synthetic oligonucleotide
cgctctgcagcttggtcctc

SEQ ID NO: 949 - DNA, 20 bp, Artificial sequence
  Synthetic oligonucleotide
ccacagcccgatccccagct

SEQ ID NO: 950 - DNA, 20 bp, Artificial sequence
  Synthetic oligonucleotide
gcaatcaggaaacggtgtgc

SEQ ID NO: 951 - DNA, 20 bp, Artificial sequence
  Synthetic oligonucleotide
tctctcactgcggaatcacc

SEQ ID NO: 952 - DNA, 20 bp, Artificial sequence
  Synthetic oligonucleotide
aatgggacacaatcttgcct

SEQ ID NO: 953 - DNA, 20 bp, Artificial sequence
  Synthetic oligonucleotide
agcactttattgagttcctg

SEQ ID NO: 954 - DNA, 20 bp, Artificial sequence
  Synthetic oligonucleotide
atcctgggacaatcctggtt

SEQ ID NO: 955 - DNA, 20 bp, Artificial sequence
  Synthetic oligonucleotide
ccacataggcctcctagtca

SEQ ID NO: 956 - DNA, 20 bp, Artificial sequence
  Synthetic oligonucleotide
tcttaaggcccatctccccc

SEQ ID NO: 957 - DNA, 20 bp, Artificial sequence
  Synthetic oligonucleotide
ctgttgctagtctgcagctt

SEQ ID NO: 958 - DNA, 20 bp, Artificial sequence
  Synthetic oligonucleotide
gccaggccacttaccgactg

SEQ ID NO: 959 - DNA, 20 bp, Artificial sequence
  Synthetic oligonucleotide
gcccatgggcataagaccta

SEQ ID NO: 960 - DNA, 20 bp, Artificial sequence
  Synthetic oligonucleotide
agcagcacatatctcaagca

SEQ ID NO: 961 - DNA, 20 bp, Artificial sequence
  Synthetic oligonucleotide
cagagacaagctcttgatcc

SEQ ID NO: 962 - DNA, 20 bp, Artificial sequence
  Synthetic oligonucleotide
gttatcaacctggtttcaca

SEQ ID NO: 963 - DNA, 20 bp, Artificial sequence
  Synthetic oligonucleotide
aaaagctaatatttgtaaag

SEQ ID NO: 964 - DNA, 20 bp, Artificial sequence
  Synthetic oligonucleotide
tgccacactctaggtaaatt

SEQ ID NO: 965 - DNA, 20 bp, Artificial sequence
  Synthetic oligonucleotide
ggttggaatgtgctgggcct

SEQ ID NO: 966 - DNA, 20 bp, Artificial sequence
  Synthetic oligonucleotide
agcatgaagttgtgtgcctg

SEQ ID NO: 967 - DNA, 20 bp, Artificial sequence
  Synthetic oligonucleotide
tttgttcaaggcaaagtgca

SEQ ID NO: 968 - DNA, 20 bp, Artificial sequence
  Synthetic oligonucleotide
accatcgcgaataatgagaa

SEQ ID NO: 969 - DNA, 20 bp, Artificial sequence
  Synthetic oligonucleotide
catacataaaaccagattat

SEQ ID NO: 970 - DNA, 20 bp, Artificial sequence
  Synthetic oligonucleotide
tagttcctaagcacaagaag

SEQ ID NO: 971 - DNA, 20 bp, Artificial sequence
  Synthetic oligonucleotide
agctctcctattgaatgagt

SEQ ID NO: 972 - DNA, 20 bp, Artificial sequence
  Synthetic oligonucleotide
agtcaatacttgaaatgttt

SEQ ID NO: 973 - DNA, 20 bp, Artificial sequence
  Synthetic oligonucleotide
aacggcagtaataatagtac

SEQ ID NO: 974 - DNA, 20 bp, Artificial sequence
  Synthetic oligonucleotide
tcccaaggccaggaagagca

SEQ ID NO: 975 - DNA, 20 bp, Artificial sequence
  Synthetic oligonucleotide
cactttctgctctaaaagtt

SEQ ID NO: 976 - DNA, 20 bp, Artificial sequence
  Synthetic oligonucleotide
cccctgtactcaactgctca

SEQ ID NO: 977 - DNA, 20 bp, Artificial sequence
  Synthetic oligonucleotide
ttggacagaaggacaggcag

SEQ ID NO: 978 - DNA, 20 bp, Artificial sequence
  Synthetic oligonucleotide
gtagcacctttcactttctt

SEQ ID NO: 979 - DNA, 20 bp, Artificial sequence
  Synthetic oligonucleotide
tccaaagggtattgtggagg

SEQ ID NO: 980 - DNA, 20 bp, Artificial sequence
  Synthetic oligonucleotide
cttgtgaccttgctactcca

SEQ ID NO: 981 - DNA, 20 bp, Artificial sequence
  Synthetic oligonucleotide
tcctcacctttctggcagtg

SEQ ID NO: 982 - DNA, 20 bp, Artificial sequence
  Synthetic oligonucleotide
gagagtctaggaccatgcca

SEQ ID NO: 983 - DNA, 20 bp, Artificial sequence
  Synthetic oligonucleotide
acaccacccggcctcctgcc

SEQ ID NO: 984 - DNA, 20 bp, Artificial sequence
  Synthetic oligonucleotide
ttctgcttgccccagaccct

SEQ ID NO: 985 - DNA, 20 bp, Artificial sequence
  Synthetic oligonucleotide
agcttgccttggtgtctgag

SEQ ID NO: 986 - DNA, 20 bp, Artificial sequence
  Synthetic oligonucleotide
tggccggaatctagctcgcc

SEQ ID NO: 987 - DNA, 20 bp, Artificial sequence
  Synthetic oligonucleotide
tccagcttcctccccgggag

SEQ ID NO: 988 - DNA, 20 bp, Artificial sequence
  Synthetic oligonucleotide
gtgcctaccctcgaactggt

SEQ ID NO: 989 - DNA, 20 bp, Artificial sequence
  Synthetic oligonucleotide
gtaggcacccggaacgatac

SEQ ID NO: 990 - DNA, 20 bp, Artificial sequence
  Synthetic oligonucleotide
tcgattctccctgtatcccc

SEQ ID NO: 991 - DNA, 20 bp, Artificial sequence
  Synthetic oligonucleotide
cagaaacccctcccccacca

SEQ ID NO: 992 - DNA, 20 bp, Artificial sequence
  Synthetic oligonucleotide
tctctcgcagcaagcccgaa

SEQ ID NO: 993 - DNA, 20 bp, Artificial sequence
  Synthetic oligonucleotide
acctggcacgcatcggtgcc

SEQ ID NO: 994 - DNA, 20 bp, Artificial sequence
  Synthetic oligonucleotide
gctgcctatccaggagtcca

SEQ ID NO: 995 - DNA, 20 bp, Artificial sequence
  Synthetic oligonucleotide
agcagcagagccctcatggc

SEQ ID NO: 996 - DNA, 20 bp, Artificial sequence
  Synthetic oligonucleotide
tggaatcgaaagtgttgact

SEQ ID NO: 997 - DNA, 20 bp, Artificial sequence
  Synthetic oligonucleotide
gaacgactgtgtgctcttca

SEQ ID NO: 998 - DNA, 20 bp, Artificial sequence
  Synthetic oligonucleotide
tacagctgccggtggtactg

SEQ ID NO: 999 - DNA, 20 bp, Artificial sequence
  Synthetic oligonucleotide
gagggcctggccggcccttg

SEQ ID NO: 1000 - DNA, 20 bp, Artificial sequence
  Synthetic oligonucleotide
tcttgggctccaaacagtat

SEQ ID NO: 1001 - DNA, 20 bp, Artificial sequence
  Synthetic oligonucleotide
cacacaggtccctcctttct

SEQ ID NO: 1002 - DNA, 20 bp, Artificial sequence
  Synthetic oligonucleotide
gcagtggtttccagtgaggt

SEQ ID NO: 1003 - DNA, 20 bp, Artificial sequence
  Synthetic oligonucleotide
aaaaaccggagaagctgagg

SEQ ID NO: 1004 - DNA, 20 bp, Artificial sequence
  Synthetic oligonucleotide
ccacagctgcttgctcagtt

SEQ ID NO: 1005 - DNA, 20 bp, Artificial sequence
  Synthetic oligonucleotide
cgctggcagtgggcatcagg

SEQ ID NO: 1006 - DNA, 20 bp, Artificial sequence
  Synthetic oligonucleotide
ggcacgggttggtgcggcag

SEQ ID NO: 1007 - DNA, 20 bp, Artificial sequence
  Synthetic oligonucleotide
ggcggtggccctccacctct

SEQ ID NO: 1008 - DNA, 20 bp, Artificial sequence
  Synthetic oligonucleotide
gcagcttgccttggtgtcca

SEQ ID NO: 1009 - DNA, 20 bp, Artificial sequence
  Synthetic oligonucleotide
tcctggccaggccgcggtag

SEQ ID NO: 1010 - DNA, 20 bp, Artificial sequence
  Synthetic oligonucleotide
gttccggtaggtggcctccg

SEQ ID NO: 1011 - DNA, 20 bp, Artificial sequence
  Synthetic oligonucleotide
cagcacgaagcaccacgggc

SEQ ID NO: 1012 - DNA, 20 bp, Artificial sequence
  Synthetic oligonucleotide
cactgtgccaggtcgcagta

SEQ ID NO: 1013 - DNA, 20 bp, Artificial sequence
  Synthetic oligonucleotide
aggcttcggcggtgccggct

SEQ ID NO: 1014 - DNA, 20 bp, Artificial sequence
  Synthetic oligonucleotide
gtcagggaaggcggctgctc

SEQ ID NO: 1015 - DNA, 20 bp, Artificial sequence
  Synthetic oligonucleotide
gactcttgcggagccgctgc

SEQ ID NO: 1016 - DNA, 20 bp, Artificial sequence
  Synthetic oligonucleotide
cgccaccagcccgccaacga

SEQ ID NO: 1017 - DNA, 20 bp, Artificial sequence
  Synthetic oligonucleotide
cgatgaggctgccggcgcag

SEQ ID NO: 1018 - DNA, 20 bp, Artificial sequence
  Synthetic oligonucleotide
cgttcctggccgagcaccac

SEQ ID NO: 1019 - DNA, 20 bp, Artificial sequence
  Synthetic oligonucleotide
aggcgcaacagagccaggtc

SEQ ID NO: 1020 - DNA, 20 bp, Artificial sequence
  Synthetic oligonucleotide
gtaaggcgacaggagcgcgc

SEQ ID NO: 1021 - DNA, 20 bp, Artificial sequence
  Synthetic oligonucleotide
cgaactggtggccccagccg

SEQ ID NO: 1022 - DNA, 20 bp, Artificial sequence
  Synthetic oligonucleotide
cctcctgcaggaagctggca

SEQ ID NO: 1023 - DNA, 20 bp, Artificial sequence
  Synthetic oligonucleotide
cgaggaaccctgcgcagagc

SEQ ID NO: 1024 - DNA, 20 bp, Artificial sequence
  Synthetic oligonucleotide
gcgctctgcagcttggtcct

SEQ ID NO: 1025 - DNA, 20 bp, Artificial sequence
  Synthetic oligonucleotide
accacagcccgatccccagc

SEQ ID NO: 1026 - DNA, 20 bp, Artificial sequence
  Synthetic oligonucleotide
gccaggtagtaggccacatc

SEQ ID NO: 1027 - DNA, 20 bp, Artificial sequence
  Synthetic oligonucleotide
agcaatcaggaaacggtgtg

SEQ ID NO: 1028 - DNA, 20 bp, Artificial sequence
  Synthetic oligonucleotide
ctctctcactgcggaatcac

SEQ ID NO: 1029 - DNA, 20 bp, Artificial sequence
  Synthetic oligonucleotide
gaatgggacacaatcttgcc

SEQ ID NO: 1030 - DNA, 20 bp, Artificial sequence
  Synthetic oligonucleotide
aagcactttattgagttcct

SEQ ID NO: 1031 - DNA, 20 bp, Artificial sequence
  Synthetic oligonucleotide
acaatcctgggacaatcctg

SEQ ID NO: 1032 - DNA, 20 bp, Artificial sequence
  Synthetic oligonucleotide
tttccacataggcctcctag

SEQ ID NO: 1033 - DNA, 20 bp, Artificial sequence
  Synthetic oligonucleotide
tcttcttaaggcccatctcc

SEQ ID NO: 1034 - DNA, 20 bp, Artificial sequence
  Synthetic oligonucleotide
gatctgttgctagtctgcag

SEQ ID NO: 1035 - DNA, 20 bp, Artificial sequence
  Synthetic oligonucleotide
ggagccaggccacttaccga

SEQ ID NO: 1036 - DNA, 20 bp, Artificial sequence
  Synthetic oligonucleotide
agtgcccatgggcataagac

SEQ ID NO: 1037 - DNA, 20 bp, Artificial sequence
  Synthetic oligonucleotide
gccagcagcacatatctcaa

SEQ ID NO: 1038 - DNA, 20 bp, Artificial sequence
  Synthetic oligonucleotide
tgccagagacaagctcttga

SEQ ID NO: 1039 - DNA, 20 bp, Artificial sequence
  Synthetic oligonucleotide
actgttatcaacctggtttc

SEQ ID NO: 1040 - DNA, 20 bp, Artificial sequence
  Synthetic oligonucleotide
ttcataataaaagctaatat

SEQ ID NO: 1041 - DNA, 20 bp, Artificial sequence
  Synthetic oligonucleotide
atgtgccacactctaggtaa

SEQ ID NO: 1042 - DNA, 20 bp, Artificial sequence
  Synthetic oligonucleotide
ccagggttggaatgtgctgg

SEQ ID NO: 1043 - DNA, 20 bp, Artificial sequence
  Synthetic oligonucleotide
ctgagcatgaagttgtgtgc

SEQ ID NO: 1044 - DNA, 20 bp, Artificial sequence
  Synthetic oligonucleotide
aagcttttgccactattttg

SEQ ID NO: 1045 - DNA, 20 bp, Artificial sequence
  Synthetic oligonucleotide
ataaccatcgcgaataatga

SEQ ID NO: 1046 - DNA, 20 bp, Artificial sequence
  Synthetic oligonucleotide
aatcatacataaaaccagat

SEQ ID NO: 1047 - DNA, 20 bp, Artificial sequence
  Synthetic oligonucleotide
gtgtagttcctaagcacaag

SEQ ID NO: 1048 - DNA, 20 bp, Artificial sequence
  Synthetic oligonucleotide
ttcagctctcctattgaatg

SEQ ID NO: 1049 - DNA, 20 bp, Artificial sequence
  Synthetic oligonucleotide
ccaagtcaatacttgaaatg

SEQ ID NO: 1050 - DNA, 20 bp, Artificial sequence
  Synthetic oligonucleotide
taaaacggcagtaataatag

SEQ ID NO: 1051 - DNA, 20 bp, Artificial sequence
  Synthetic oligonucleotide
cagtcccaaggccaggaaga

SEQ ID NO: 1052 - DNA, 20 bp, Artificial sequence
  Synthetic oligonucleotide
aaacactttctgctctaaaa

SEQ ID NO: 1053 - DNA, 20 bp, Artificial sequence
  Synthetic oligonucleotide
cttcccctgtactcaactgc

SEQ ID NO: 1054 - DNA, 20 bp, Artificial sequence
  Synthetic oligonucleotide
tccttggacagaaggacagg

SEQ ID NO: 1055 - DNA, 20 bp, Artificial sequence
  Synthetic oligonucleotide
tgtgtagcacctttcacttt

SEQ ID NO: 1056 - DNA, 20 bp, Artificial sequence
  Synthetic oligonucleotide
acttccaaagggtattgtgg

SEQ ID NO: 1057 - DNA, 20 bp, Artificial sequence
  Synthetic oligonucleotide
tgccttgtgaccttgctact

SEQ ID NO: 1058 - DNA, 20 bp, Artificial sequence
  Synthetic oligonucleotide
atctcctcacctttctggca

SEQ ID NO: 1059 - DNA, 20 bp, Artificial sequence
  Synthetic oligonucleotide
caggagagtctaggaccatg

SEQ ID NO: 1060 - DNA, 20 bp, Artificial sequence
  Synthetic oligonucleotide
ggcacaccacccggcctcct

SEQ ID NO: 1061 - DNA, 20 bp, Artificial sequence
  Synthetic oligonucleotide
gccttctgcttgccccagac

SEQ ID NO: 1062 - DNA, 20 bp, Artificial sequence
  Synthetic oligonucleotide
agcagcttgccttggtgtct

SEQ ID NO: 1063 - DNA, 20 bp, Artificial sequence
  Synthetic oligonucleotide
ggctggccggaatctagctc

SEQ ID NO: 1064 - DNA, 20 bp, Artificial sequence
  Synthetic oligonucleotide
tgttccagcttcctccccgg

SEQ ID NO: 1065 - DNA, 20 bp, Artificial sequence
  Synthetic oligonucleotide
gttgtgcctaccctcgaact

SEQ ID NO: 1066 - DNA, 20 bp, Artificial sequence
  Synthetic oligonucleotide
tctgtaggcacccggaacga

SEQ ID NO: 1067 - DNA, 20 bp, Artificial sequence
  Synthetic oligonucleotide
agttcgattctccctgtatc

SEQ ID NO: 1068 - DNA, 20 bp, Artificial sequence
  Synthetic oligonucleotide
aaacagaaacccctccccca

SEQ ID NO: 1069 - DNA, 20 bp, Artificial sequence
  Synthetic oligonucleotide
tcctctctcgcagcaagccc

SEQ ID NO: 1070 - DNA, 20 bp, Artificial sequence
  Synthetic oligonucleotide
ctcacctggcacgcatcggt

SEQ ID NO: 1071 - DNA, 20 bp, Artificial sequence
  Synthetic oligonucleotide
cagctgcctatccaggagtc

SEQ ID NO: 1072 - DNA, 20 bp, Artificial sequence
  Synthetic oligonucleotide
ggagcagcagagccctcatg

SEQ ID NO: 1073 - DNA, 20 bp, Artificial sequence
  Synthetic oligonucleotide
aggtggaatcgaaagtgttg

SEQ ID NO: 1074 - DNA, 20 bp, Artificial sequence
  Synthetic oligonucleotide
tgagaacgactgtgtgctct

SEQ ID NO: 1075 - DNA, 20 bp, Artificial sequence
  Synthetic oligonucleotide
ggtacagctgccggtggtac

SEQ ID NO: 1076 - DNA, 20 bp, Artificial sequence
  Synthetic oligonucleotide
ctgagggcctggccggccct

SEQ ID NO: 1077 - DNA, 20 bp, Artificial sequence
  Synthetic oligonucleotide
ctttcttgggctccaaacag

SEQ ID NO: 1078 - DNA, 20 bp, Artificial sequence
  Synthetic oligonucleotide
gttcacacaggtccctcctt

SEQ ID NO: 1079 - DNA, 20 bp, Artificial sequence
  Synthetic oligonucleotide
ctggcagtggtttccagtga

SEQ ID NO: 1080 - DNA, 20 bp, Artificial sequence
  Synthetic oligonucleotide
tggaaaaaccggagaagctg

SEQ ID NO: 1081 - DNA, 20 bp, Artificial sequence
  Synthetic oligonucleotide
tggccacagctgcttgctca

SEQ ID NO: 1082 - DNA, 20 bp, Artificial sequence
  Synthetic oligonucleotide
gccgctggcagtgggcatca

SEQ ID NO: 1083 - DNA, 20 bp, Artificial sequence
  Synthetic oligonucleotide
ggaggcacgggttggtgcgg

SEQ ID NO: 1084 - DNA, 20 bp, Artificial sequence
  Synthetic oligonucleotide
acaggcggtggccctccacc

SEQ ID NO: 1085 - DNA, 20 bp, Artificial sequence
  Synthetic oligonucleotide
catagcagcttgccttggtg

SEQ ID NO: 1086 - DNA, 20 bp, Artificial sequence
  Synthetic oligonucleotide
tggtcctggccaggccgcgg

SEQ ID NO: 1087 - DNA, 20 bp, Artificial sequence
  Synthetic oligonucleotide
gcgcttgctcggcagtcacg

SEQ ID NO: 1088 - DNA, 20 bp, Artificial sequence
  Synthetic oligonucleotide
gttcagcacgaagcaccacg

SEQ ID NO: 1089 - DNA, 20 bp, Artificial sequence
  Synthetic oligonucleotide
ggcactgtgccaggtcgcag

SEQ ID NO: 1090 - DNA, 20 bp, Artificial sequence
  Synthetic oligonucleotide
tgaggcttcggcggtgccgg

SEQ ID NO: 1091 - DNA, 20 bp, Artificial sequence
  Synthetic oligonucleotide
cctggtcagggaaggcggct

SEQ ID NO: 1092 - DNA, 20 bp, Artificial sequence
  Synthetic oligonucleotide
cagactcttgcggagccgct

SEQ ID NO: 1093 - DNA, 20 bp, Artificial sequence
  Synthetic oligonucleotide
gtacagcgcggcgatgtagg

SEQ ID NO: 1094 - DNA, 20 bp, Artificial sequence
  Synthetic oligonucleotide
ctcacagctgtggttacggc

SEQ ID NO: 1095 - DNA, 20 bp, Artificial sequence
  Synthetic oligonucleotide
tgaaggcgcaacagagccag

SEQ ID NO: 1096 - DNA, 20 bp, Artificial sequence
  Synthetic oligonucleotide
ctcgaactggtggccccagc

SEQ ID NO: 1097 - DNA, 20 bp, Artificial sequence
  Synthetic oligonucleotide
gcgcctcctgcaggaagctg

SEQ ID NO: 1098 - DNA, 20 bp, Artificial sequence
  Synthetic oligonucleotide
cctcgaggaaccctgcgcag

SEQ ID NO: 1099 - DNA, 20 bp, Artificial sequence
  Synthetic oligonucleotide
gccttgcagggtgagccggc

SEQ ID NO: 1100 - DNA, 20 bp, Artificial sequence
  Synthetic oligonucleotide
tcaccacagcccgatcccca

SEQ ID NO: 1101 - DNA, 20 bp, Artificial sequence
  Synthetic oligonucleotide
aggccaggtagtaggccaca

SEQ ID NO: 1102 - DNA, 20 bp, Artificial sequence
  Synthetic oligonucleotide
ccctgagcaatcaggaaacg

SEQ ID NO: 1103 - DNA, 20 bp, Artificial sequence
  Synthetic oligonucleotide
ccactctctcactgcggaat

SEQ ID NO: 1104 - DNA, 20 bp, Artificial sequence
  Synthetic oligonucleotide
gcggagctggccgcactggg

SEQ ID NO: 1105 - DNA, 20 bp, Artificial sequence
  Synthetic oligonucleotide
caaagcactttattgagttc

SEQ ID NO: 1106 - DNA, 20 bp, Artificial sequence
  Synthetic oligonucleotide
cccagaacaatcctgggaca

SEQ ID NO: 1107 - DNA, 20 bp, Artificial sequence
  Synthetic oligonucleotide
ctcacctttccacataggcc

SEQ ID NO: 1108 - DNA, 20 bp, Artificial sequence
  Synthetic oligonucleotide
ccgttgtcttcttaaggccc

SEQ ID NO: 1109 - DNA, 20 bp, Artificial sequence
  Synthetic oligonucleotide
gccaccgatctgttgctagt

SEQ ID NO: 1110 - DNA, 20 bp, Artificial sequence
  Synthetic oligonucleotide
ccgggaggaggagccaggcc

SEQ ID NO: 1111 - DNA, 20 bp, Artificial sequence
  Synthetic oligonucleotide
cactctagtgcccatgggca

SEQ ID NO: 1112 - DNA, 20 bp, Artificial sequence
  Synthetic oligonucleotide
caggagcccaggtgtgatgg

SEQ ID NO: 1113 - DNA, 20 bp, Artificial sequence
  Synthetic oligonucleotide
ttcagatgccagagacaagc

SEQ ID NO: 1114 - DNA, 20 bp, Artificial sequence
  Synthetic oligonucleotide
aggtttactgttatcaacct

SEQ ID NO: 1115 - DNA, 20 bp, Artificial sequence
  Synthetic oligonucleotide
ggtagtttcataataaaagc

SEQ ID NO: 1116 - DNA, 20 bp, Artificial sequence
  Synthetic oligonucleotide
cctgctatgtgccacactct

SEQ ID NO: 1117 - DNA, 20 bp, Artificial sequence
  Synthetic oligonucleotide
ggaggctgagggagtccagg

SEQ ID NO: 1118 - DNA, 20 bp, Artificial sequence
  Synthetic oligonucleotide
aattagctgagcatgaagtt

SEQ ID NO: 1119 - DNA, 20 bp, Artificial sequence
  Synthetic oligonucleotide
ctcaataagcttttgccact

SEQ ID NO: 1120 - DNA, 20 bp, Artificial sequence
  Synthetic oligonucleotide
tagaacataaccatcgcgaa

SEQ ID NO: 1121 - DNA, 20 bp, Artificial sequence
  Synthetic oligonucleotide
atgtctttaaacagaatcat

SEQ ID NO: 1122 - DNA, 20 bp, Artificial sequence
  Synthetic oligonucleotide
agagctgtgtagttcctaag

SEQ ID NO: 1123 - DNA, 20 bp, Artificial sequence
  Synthetic oligonucleotide
gcttgtttcagctctcctat

SEQ ID NO: 1124 - DNA, 20 bp, Artificial sequence
  Synthetic oligonucleotide
taactcccaagtcaatactt

SEQ ID NO: 1125 - DNA, 20 bp, Artificial sequence
  Synthetic oligonucleotide
tgatctgagccttggtttcc

SEQ ID NO: 1126 - DNA, 20 bp, Artificial sequence
  Synthetic oligonucleotide
agtcttcagtcccaaggcca

SEQ ID NO: 1127 - DNA, 20 bp, Artificial sequence
  Synthetic oligonucleotide
cattgaaaacactttctgct

SEQ ID NO: 1128 - DNA, 20 bp, Artificial sequence
  Synthetic oligonucleotide
tgaggacttcccctgtactc

SEQ ID NO: 1129 - DNA, 20 bp, Artificial sequence
  Synthetic oligonucleotide
cagagttccttggacagaag

SEQ ID NO: 1130 - DNA, 20 bp, Artificial sequence
  Synthetic oligonucleotide
aggctgtgtgtagcaccttt

SEQ ID NO: 1131 - DNA, 20 bp, Artificial sequence
  Synthetic oligonucleotide
ctctggacttccaaagggta

SEQ ID NO: 1132 - DNA, 20 bp, Artificial sequence
  Synthetic oligonucleotide
cctacttgccttgtgacctt

SEQ ID NO: 1133 - DNA, 20 bp, Artificial sequence
  Synthetic oligonucleotide
ctccacatctcctcaccttt

SEQ ID NO: 1134 - DNA, 20 bp, Artificial sequence
  Synthetic oligonucleotide
tggtctcaggagagtctagg

SEQ ID NO: 1135 - DNA, 20 bp, Artificial sequence
  Synthetic oligonucleotide
cttcctggcacaccacccgg

SEQ ID NO: 1136 - DNA, 20 bp, Artificial sequence
  Synthetic oligonucleotide
gggctggccttctgcttgcc

SEQ ID NO: 1137 - DNA, 20 bp, Artificial sequence
  Synthetic oligonucleotide
acgcggcgcaccggcagaag

SEQ ID NO: 1138 - DNA, 20 bp, Artificial sequence
  Synthetic oligonucleotide
cccgcggccggctggccgga

SEQ ID NO: 1139 - DNA, 20 bp, Artificial sequence
  Synthetic oligonucleotide
atcccgtgttccagcttcct

SEQ ID NO: 1140 - DNA, 20 bp, Artificial sequence
  Synthetic oligonucleotide
ctagcagttgtgcctaccct

SEQ ID NO: 1141 - DNA, 20 bp, Artificial sequence
  Synthetic oligonucleotide
acccattctgtaggcacccg

SEQ ID NO: 1142 - DNA, 20 bp, Artificial sequence
  Synthetic oligonucleotide
agagcaagttcgattctccc

SEQ ID NO: 1143 - DNA, 20 bp, Artificial sequence
  Synthetic oligonucleotide
gagcggaaacagaaacccct

SEQ ID NO: 1144 - DNA, 20 bp, Artificial sequence
  Synthetic oligonucleotide
tgcccttcctctctcgcagc

SEQ ID NO: 1145 - DNA, 20 bp, Artificial sequence
  Synthetic oligonucleotide
taagagctcacctggcacgc

SEQ ID NO: 1146 - DNA, 20 bp, Artificial sequence
  Synthetic oligonucleotide
agctgcctatccaggagtcc

SEQ ID NO: 1147 - DNA, 20 bp, Artificial sequence
  Synthetic oligonucleotide
gagcagcagagccctcatgg

SEQ ID NO: 1148 - DNA, 20 bp, Artificial sequence
  Synthetic oligonucleotide
gtggaatcgaaagtgttgac

SEQ ID NO: 1149 - DNA, 20 bp, Artificial sequence
  Synthetic oligonucleotide
gagaacgactgtgtgctctt

SEQ ID NO: 1150 - DNA, 20 bp, Artificial sequence
  Synthetic oligonucleotide
gtacagctgccggtggtact

SEQ ID NO: 1151 - DNA, 20 bp, Artificial sequence
  Synthetic oligonucleotide
tgagggcctggccggccctt

SEQ ID NO: 1152 - DNA, 20 bp, Artificial sequence
  Synthetic oligonucleotide
ttcttgggctccaaacagta

SEQ ID NO: 1153 - DNA, 20 bp, Artificial sequence
  Synthetic oligonucleotide
ttcacacaggtccctccttt

SEQ ID NO: 1154 - DNA, 20 bp, Artificial sequence
  Synthetic oligonucleotide
ggcagtggtttccagtgagg

SEQ ID NO: 1155 - DNA, 20 bp, Artificial sequence
  Synthetic oligonucleotide
ggaaaaaccggagaagctga

SEQ ID NO: 1156 - DNA, 20 bp, Artificial sequence
  Synthetic oligonucleotide
gccacagctgcttgctcagt

SEQ ID NO: 1157 - DNA, 20 bp, Artificial sequence
  Synthetic oligonucleotide
ccgctggcagtgggcatcag

SEQ ID NO: 1158 - DNA, 20 bp, Artificial sequence
  Synthetic oligonucleotide
gaggcacgggttggtgcggc

SEQ ID NO: 1159 - DNA, 20 bp, Artificial sequence
  Synthetic oligonucleotide
caggcggtggccctccacct

SEQ ID NO: 1160 - DNA, 20 bp, Artificial sequence
  Synthetic oligonucleotide
agcagcttgccttggtgtcc

SEQ ID NO: 1161 - DNA, 20 bp, Artificial sequence
  Synthetic oligonucleotide
gtcctggccaggccgcggta

SEQ ID NO: 1162 - DNA, 20 bp, Artificial sequence
  Synthetic oligonucleotide
cgttccggtaggtggcctcc

SEQ ID NO: 1163 - DNA, 20 bp, Artificial sequence
  Synthetic oligonucleotide
ttcagcacgaagcaccacgg

SEQ ID NO: 1164 - DNA, 20 bp, Artificial sequence
  Synthetic oligonucleotide
gcactgtgccaggtcgcagt

SEQ ID NO: 1165 - DNA, 20 bp, Artificial sequence
  Synthetic oligonucleotide
gaggcttcggcggtgccggc

SEQ ID NO: 1166 - DNA, 20 bp, Artificial sequence
  Synthetic oligonucleotide
tggtcagggaaggcggctgc

SEQ ID NO: 1167 - DNA, 20 bp, Artificial sequence
  Synthetic oligonucleotide
agactcttgcggagccgctg

SEQ ID NO: 1168 - DNA, 20 bp, Artificial sequence
  Synthetic oligonucleotide
gcgccaccagcccgccaacg

SEQ ID NO: 1169 - DNA, 20 bp, Artificial sequence
  Synthetic oligonucleotide
gcgatgaggctgccggcgca

SEQ ID NO: 1170 - DNA, 20 bp, Artificial sequence
  Synthetic oligonucleotide
tcacagctgtggttacggcg

SEQ ID NO: 1171 - DNA, 20 bp, Artificial sequence
  Synthetic oligonucleotide
aaggcgcaacagagccaggt

SEQ ID NO: 1172 - DNA, 20 bp, Artificial sequence
  Synthetic oligonucleotide
cgtaaggcgacaggagcgcg

SEQ ID NO: 1173 - DNA, 20 bp, Artificial sequence
  Synthetic oligonucleotide
gcctcctgcaggaagctggc

SEQ ID NO: 1174 - DNA, 20 bp, Artificial sequence
  Synthetic oligonucleotide
tcgaggaaccctgcgcagag

SEQ ID NO: 1175 - DNA, 20 bp, Artificial sequence
  Synthetic oligonucleotide
ccttgcagggtgagccggcg

SEQ ID NO: 1176 - DNA, 20 bp, Artificial sequence
  Synthetic oligonucleotide
caccacagcccgatccccag

SEQ ID NO: 1177 - DNA, 20 bp, Artificial sequence
  Synthetic oligonucleotide
ggccaggtagtaggccacat

SEQ ID NO: 1178 - DNA, 20 bp, Artificial sequence
  Synthetic oligonucleotide
ctgagcaatcaggaaacggt

SEQ ID NO: 1179 - DNA, 20 bp, Artificial sequence
  Synthetic oligonucleotide
actctctcactgcggaatca

SEQ ID NO: 1180 - DNA, 20 bp, Artificial sequence
  Synthetic oligonucleotide
ggaatgggacacaatcttgc

SEQ ID NO: 1181 - DNA, 20 bp, Artificial sequence
  Synthetic oligonucleotide
agaacaatcctgggacaatc

SEQ ID NO: 1182 - DNA, 20 bp, Artificial sequence
  Synthetic oligonucleotide
acctttccacataggcctcc

SEQ ID NO: 1183 - DNA, 20 bp, Artificial sequence
  Synthetic oligonucleotide
ttgtcttcttaaggcccatc

SEQ ID NO: 1184 - DNA, 20 bp, Artificial sequence
  Synthetic oligonucleotide
accgatctgttgctagtctg

SEQ ID NO: 1185 - DNA, 20 bp, Artificial sequence
  Synthetic oligonucleotide
ggaggaggagccaggccact

SEQ ID NO: 1186 - DNA, 20 bp, Artificial sequence
  Synthetic oligonucleotide
tctagtgcccatgggcataa

SEQ ID NO: 1187 - DNA, 20 bp, Artificial sequence
  Synthetic oligonucleotide
gagcccaggtgtgatggcgc

SEQ ID NO: 1188 - DNA, 20 bp, Artificial sequence
  Synthetic oligonucleotide
agatgccagagacaagctct

SEQ ID NO: 1189 - DNA, 20 bp, Artificial sequence
  Synthetic oligonucleotide
tttactgttatcaacctggt

SEQ ID NO: 1190 - DNA, 20 bp, Artificial sequence
  Synthetic oligonucleotide
agtttcataataaaagctaa

SEQ ID NO: 1191 - DNA, 20 bp, Artificial sequence
  Synthetic oligonucleotide
gctatgtgccacactctagg

SEQ ID NO: 1192 - DNA, 20 bp, Artificial sequence
  Synthetic oligonucleotide
agtccagggttggaatgtgc

SEQ ID NO: 1193 - DNA, 20 bp, Artificial sequence
  Synthetic oligonucleotide
tagctgagcatgaagttgtg

SEQ ID NO: 1194 - DNA, 20 bp, Artificial sequence
  Synthetic oligonucleotide
aataagcttttgccactatt

SEQ ID NO: 1195 - DNA, 20 bp, Artificial sequence
  Synthetic oligonucleotide
aacataaccatcgcgaataa

SEQ ID NO: 1196 - DNA, 20 bp, Artificial sequence
  Synthetic oligonucleotide
cagaatcatacataaaacca

SEQ ID NO: 1197 - DNA, 20 bp, Artificial sequence
  Synthetic oligonucleotide
gctgtgtagttcctaagcac

SEQ ID NO: 1198 - DNA, 20 bp, Artificial sequence
  Synthetic oligonucleotide
tgtttcagctctcctattga

SEQ ID NO: 1199 - DNA, 20 bp, Artificial sequence
  Synthetic oligonucleotide
ctcccaagtcaatacttgaa

SEQ ID NO: 1200 - DNA, 20 bp, Artificial sequence
  Synthetic oligonucleotide
ttatctgtaaaacggcagta

SEQ ID NO: 1201 - DNA, 20 bp, Artificial sequence
  Synthetic oligonucleotide
cttcagtcccaaggccagga

SEQ ID NO: 1202 - DNA, 20 bp, Artificial sequence
  Synthetic oligonucleotide
tgaaaacactttctgctcta

SEQ ID NO: 1203 - DNA, 20 bp, Artificial sequence
  Synthetic oligonucleotide
ggacttcccctgtactcaac

SEQ ID NO: 1204 - DNA, 20 bp, Artificial sequence
  Synthetic oligonucleotide
agttccttggacagaaggac

SEQ ID NO: 1205 - DNA, 20 bp, Artificial sequence
  Synthetic oligonucleotide
ctgtgtgtagcacctttcac

SEQ ID NO: 1206 - DNA, 20 bp, Artificial sequence
  Synthetic oligonucleotide
tggacttccaaagggtattg

SEQ ID NO: 1207 - DNA, 20 bp, Artificial sequence
  Synthetic oligonucleotide
acttgccttgtgaccttgct

SEQ ID NO: 1208 - DNA, 20 bp, Artificial sequence
  Synthetic oligonucleotide
cacatctcctcacctttctg

SEQ ID NO: 1209 - DNA, 20 bp, Artificial sequence
  Synthetic oligonucleotide
tctcaggagagtctaggacc

SEQ ID NO: 1210 - DNA, 20 bp, Artificial sequence
  Synthetic oligonucleotide
cctggcacaccacccggcct

SEQ ID NO: 1211 - DNA, 20 bp, Artificial sequence
  Synthetic oligonucleotide
ctggccttctgcttgcccca

SEQ ID NO: 1212 - DNA, 20 bp, Artificial sequence
  Synthetic oligonucleotide
cggcgcaccggcagaaggcg

SEQ ID NO: 1213 - DNA, 20 bp, Artificial sequence
  Synthetic oligonucleotide
gccggctggccggaatctag

SEQ ID NO: 1214 - DNA, 20 bp, Artificial sequence
  Synthetic oligonucleotide
ccgtgttccagcttcctccc

SEQ ID NO: 1215 - DNA, 20 bp, Artificial sequence
  Synthetic oligonucleotide
gcagttgtgcctaccctcga

SEQ ID NO: 1216 - DNA, 20 bp, Artificial sequence
  Synthetic oligonucleotide
cattctgtaggcacccggaa

SEQ ID NO: 1217 - DNA, 20 bp, Artificial sequence
  Synthetic oligonucleotide
gcaagttcgattctccctgt

SEQ ID NO: 1218 - DNA, 20 bp, Artificial sequence
  Synthetic oligonucleotide
cggaaacagaaacccctccc

SEQ ID NO: 1219 - DNA, 20 bp, Artificial sequence
  Synthetic oligonucleotide
ccttcctctctcgcagcaag

SEQ ID NO: 1220 - DNA, 20 bp, Artificial sequence
  Synthetic oligonucleotide
gagctcacctggcacgcatc

SEQ ID NO: 1221 - DNA, 20 bp, Artificial sequence
  Synthetic oligonucleotide
ccagctgcctatccaggagt

SEQ ID NO: 1222 - DNA, 20 bp, Artificial sequence
  Synthetic oligonucleotide
aggagcagcagagccctcat

SEQ ID NO: 1223 - DNA, 20 bp, Artificial sequence
  Synthetic oligonucleotide
aaggtggaatcgaaagtgtt

SEQ ID NO: 1224 - DNA, 20 bp, Artificial sequence
  Synthetic oligonucleotide
gtgagaacgactgtgtgctc

SEQ ID NO: 1225 - DNA, 20 bp, Artificial sequence
  Synthetic oligonucleotide
tggtacagctgccggtggta

SEQ ID NO: 1226 - DNA, 20 bp, Artificial sequence
  Synthetic oligonucleotide
gctgagggcctggccggccc

SEQ ID NO: 1227 - DNA, 20 bp, Artificial sequence
  Synthetic oligonucleotide
actttcttgggctccaaaca

SEQ ID NO: 1228 - DNA, 20 bp, Artificial sequence
  Synthetic oligonucleotide
tgttcacacaggtccctcct

SEQ ID NO: 1229 - DNA, 20 bp, Artificial sequence
  Synthetic oligonucleotide
tttctggcagtggtttccag

SEQ ID NO: 1230 - DNA, 20 bp, Artificial sequence
  Synthetic oligonucleotide
tcttgtggaaaaaccggaga

SEQ ID NO: 1231 - DNA, 20 bp, Artificial sequence
  Synthetic oligonucleotide
ctggccacagctgcttgctc

SEQ ID NO: 1232 - DNA, 20 bp, Artificial sequence
  Synthetic oligonucleotide
cagccgctggcagtgggcat

SEQ ID NO: 1233 - DNA, 20 bp, Artificial sequence
  Synthetic oligonucleotide
atggaggcacgggttggtgc

SEQ ID NO: 1234 - DNA, 20 bp, Artificial sequence
  Synthetic oligonucleotide
gcacaggcggtggccctcca

SEQ ID NO: 1235 - DNA, 20 bp, Artificial sequence
  Synthetic oligonucleotide
tcatagcagcttgccttggt

SEQ ID NO: 1236 - DNA, 20 bp, Artificial sequence
  Synthetic oligonucleotide
gtggtcctggccaggccgcg

SEQ ID NO: 1237 - DNA, 20 bp, Artificial sequence
  Synthetic oligonucleotide
cgcgcttgctcggcagtcac

SEQ ID NO: 1238 - DNA, 20 bp, Artificial sequence
  Synthetic oligonucleotide
ggttcagcacgaagcaccac

SEQ ID NO: 1239 - DNA, 20 bp, Artificial sequence
  Synthetic oligonucleotide
tggcactgtgccaggtcgca

SEQ ID NO: 1240 - DNA, 20 bp, Artificial sequence
  Synthetic oligonucleotide
ctgaggcttcggcggtgccg

SEQ ID NO: 1241 - DNA, 20 bp, Artificial sequence
  Synthetic oligonucleotide
tcctggtcagggaaggcggc

SEQ ID NO: 1242 - DNA, 20 bp, Artificial sequence
  Synthetic oligonucleotide
agtacagcgcggcgatgtag

SEQ ID NO: 1243 - DNA, 20 bp, Artificial sequence
  Synthetic oligonucleotide
gggcgatgaggctgccggcg

SEQ ID NO: 1244 - DNA, 20 bp, Artificial sequence
  Synthetic oligonucleotide
gctcacagctgtggttacgg

SEQ ID NO: 1245 - DNA, 20 bp, Artificial sequence
  Synthetic oligonucleotide
ctgaaggcgcaacagagcca

SEQ ID NO: 1246 - DNA, 20 bp, Artificial sequence
  Synthetic oligonucleotide
ggcaggcacaccggctgaac

SEQ ID NO: 1247 - DNA, 20 bp, Artificial sequence
  Synthetic oligonucleotide
cctcgaactggtggccccag

SEQ ID NO: 1248 - DNA, 20 bp, Artificial sequence
  Synthetic oligonucleotide
tgcgcctcctgcaggaagct

SEQ ID NO: 1249 - DNA, 20 bp, Artificial sequence
  Synthetic oligonucleotide
ccctcgaggaaccctgcgca

SEQ ID NO: 1250 - DNA, 20 bp, Artificial sequence
  Synthetic oligonucleotide
tgccttgcagggtgagccgg

SEQ ID NO: 1251 - DNA, 20 bp, Artificial sequence
  Synthetic oligonucleotide
gtcaccacagcccgatcccc

SEQ ID NO: 1252 - DNA, 20 bp, Artificial sequence
  Synthetic oligonucleotide
caggccaggtagtaggccac

SEQ ID NO: 1253 - DNA, 20 bp, Artificial sequence
  Synthetic oligonucleotide
agccactctctcactgcgga

SEQ ID NO: 1254 - DNA, 20 bp, Artificial sequence
  Synthetic oligonucleotide
cgcggagctggccgcactgg

SEQ ID NO: 1255 - DNA, 20 bp, Artificial sequence
  Synthetic oligonucleotide
tcaaagcactttattgagtt

SEQ ID NO: 1256 - DNA, 20 bp, Artificial sequence
  Synthetic oligonucleotide
ccccccagaacaatcctggg

SEQ ID NO: 1257 - DNA, 20 bp, Artificial sequence
  Synthetic oligonucleotide
ggcctcacctttccacatag

SEQ ID NO: 1258 - DNA, 20 bp, Artificial sequence
  Synthetic oligonucleotide
cccccgttgtcttcttaagg

SEQ ID NO: 1259 - DNA, 20 bp, Artificial sequence
  Synthetic oligonucleotide
cctgccaccgatctgttgct

SEQ ID NO: 1260 - DNA, 20 bp, Artificial sequence
  Synthetic oligonucleotide
ttcccgggaggaggagccag

SEQ ID NO: 1261 - DNA, 20 bp, Artificial sequence
  Synthetic oligonucleotide
gatcactctagtgcccatgg

SEQ ID NO: 1262 - DNA, 20 bp, Artificial sequence
  Synthetic oligonucleotide
tggcaggagcccaggtgtga

SEQ ID NO: 1263 - DNA, 20 bp, Artificial sequence
  Synthetic oligonucleotide
gcattcagatgccagagaca

SEQ ID NO: 1264 - DNA, 20 bp, Artificial sequence
  Synthetic oligonucleotide
aagaggtttactgttatcaa

SEQ ID NO: 1265 - DNA, 20 bp, Artificial sequence
  Synthetic oligonucleotide
aaaggtagtttcataataaa

SEQ ID NO: 1266 - DNA, 20 bp, Artificial sequence
  Synthetic oligonucleotide
ggccctgctatgtgccacac

SEQ ID NO: 1267 - DNA, 20 bp, Artificial sequence
  Synthetic oligonucleotide
agaggaggctgagggagtcc

SEQ ID NO: 1268 - DNA, 20 bp, Artificial sequence
  Synthetic oligonucleotide
acctttaagatgcaaatggg

SEQ ID NO: 1269 - DNA, 20 bp, Artificial sequence
  Synthetic oligonucleotide
ctgctcaataagcttttgcc

SEQ ID NO: 1270 - DNA, 20 bp, Artificial sequence
  Synthetic oligonucleotide
ttatagaacataaccatcgc

SEQ ID NO: 1271 - DNA, 20 bp, Artificial sequence
  Synthetic oligonucleotide
catatactaaataaaatgtc

SEQ ID NO: 1272 - DNA, 20 bp, Artificial sequence
  Synthetic oligonucleotide
tgaagagctgtgtagttcct

SEQ ID NO: 1273 - DNA, 20 bp, Artificial sequence
  Synthetic oligonucleotide
gctgcttgtttcagctctcc

SEQ ID NO: 1274 - DNA, 20 bp, Artificial sequence
  Synthetic oligonucleotide
ttgtaactcccaagtcaata

SEQ ID NO: 1275 - DNA, 20 bp, Artificial sequence
  Synthetic oligonucleotide
ctctgatctgagccttggtt

SEQ ID NO: 1276 - DNA, 20 bp, Artificial sequence
  Synthetic oligonucleotide
gtaagtcttcagtcccaagg

SEQ ID NO: 1277 - DNA, 20 bp, Artificial sequence
  Synthetic oligonucleotide
gtgcattgaaaacactttct

SEQ ID NO: 1278 - DNA, 20 bp, Artificial sequence
  Synthetic oligonucleotide
ctctgaggacttcccctgta

SEQ ID NO: 1279 - DNA, 20 bp, Artificial sequence
  Synthetic oligonucleotide
aagcagagttccttggacag

SEQ ID NO: 1280 - DNA, 20 bp, Artificial sequence
  Synthetic oligonucleotide
cagaggctgtgtgtagcacc

SEQ ID NO: 1281 - DNA, 20 bp, Artificial sequence
  Synthetic oligonucleotide
tccctctggacttccaaagg

SEQ ID NO: 1282 - DNA, 20 bp, Artificial sequence
  Synthetic oligonucleotide
gaacctacttgccttgtgac

SEQ ID NO: 1283 - DNA, 20 bp, Artificial sequence
  Synthetic oligonucleotide
gtcctccacatctcctcacc

SEQ ID NO: 1284 - DNA, 20 bp, Artificial sequence
  Synthetic oligonucleotide
tagtggtctcaggagagtct

SEQ ID NO: 1285 - DNA, 20 bp, Artificial sequence
  Synthetic oligonucleotide
ctccttcctggcacaccacc

SEQ ID NO: 1286 - DNA, 20 bp, Artificial sequence
  Synthetic oligonucleotide
gcaagcccgtcccacctggg

SEQ ID NO: 1287 - DNA, 20 bp, Artificial sequence
  Synthetic oligonucleotide
cccacgcggcgcaccggcag

SEQ ID NO: 1288 - DNA, 20 bp, Artificial sequence
  Synthetic oligonucleotide
gagcccgcggccggctggcc

SEQ ID NO: 1289 - DNA, 20 bp, Artificial sequence
  Synthetic oligonucleotide
ccaatcccgtgttccagctt

SEQ ID NO: 1290 - DNA, 20 bp, Artificial sequence
  Synthetic oligonucleotide
cccctagcagttgtgcctac

SEQ ID NO: 1291 - DNA, 20 bp, Artificial sequence
  Synthetic oligonucleotide
gccacccattctgtaggcac

SEQ ID NO: 1292 - DNA, 20 bp, Artificial sequence
  Synthetic oligonucleotide
ccaagagcaagttcgattct

SEQ ID NO: 1293 - DNA, 20 bp, Artificial sequence
  Synthetic oligonucleotide
gcggagcggaaacagaaacc

SEQ ID NO: 1294 - DNA, 20 bp, Artificial sequence
  Synthetic oligonucleotide
tcatgcccttcctctctcgc

SEQ ID NO: 1295 - DNA, 20 bp, Artificial sequence
  Synthetic oligonucleotide
ccgggctaagagctcacctg

SEQ ID NO: 1296 - DNA, 20 bp, Artificial sequence
  Synthetic oligonucleotide
gtccagctgcctatccagga

SEQ ID NO: 1297 - DNA, 20 bp, Artificial sequence
  Synthetic oligonucleotide
gaaccccaggagcagcagag

SEQ ID NO: 1298 - DNA, 20 bp, Artificial sequence
  Synthetic oligonucleotide
cttcccaaggtggaatcgaa

SEQ ID NO: 1299 - DNA, 20 bp, Artificial sequence
  Synthetic oligonucleotide
cagtgagaacgactgtgtgc

SEQ ID NO: 1300 - DNA, 20 bp, Artificial sequence
  Synthetic oligonucleotide
tgtggtacagctgccggtgg

SEQ ID NO: 1301 - DNA, 20 bp, Artificial sequence
  Synthetic oligonucleotide
gtagcacaccagggctgagg

SEQ ID NO: 1302 - DNA, 20 bp, Artificial sequence
  Synthetic oligonucleotide
tcactttcttgggctccaaa

SEQ ID NO: 1303 - DNA, 20 bp, Artificial sequence
  Synthetic oligonucleotide
ggcatgttcacacaggtccc

SEQ ID NO: 1304 - DNA, 20 bp, Artificial sequence
  Synthetic oligonucleotide
tctttctggcagtggtttcc

SEQ ID NO: 1305 - DNA, 20 bp, Artificial sequence
  Synthetic oligonucleotide
attcttgtggaaaaaccgga

SEQ ID NO: 1306 - DNA, 20 bp, Artificial sequence
  Synthetic oligonucleotide
atctggccacagctgcttgc

SEQ ID NO: 1307 - DNA, 20 bp, Artificial sequence
  Synthetic oligonucleotide
gccagccgctggcagtgggc

SEQ ID NO: 1308 - DNA, 20 bp, Artificial sequence
  Synthetic oligonucleotide
cccatggaggcacgggttgg

SEQ ID NO: 1309 - DNA, 20 bp, Artificial sequence
  Synthetic oligonucleotide
gtggcacaggcggtggccct

SEQ ID NO: 1310 - DNA, 20 bp, Artificial sequence
  Synthetic oligonucleotide
gccatcatagcagcttgcct

SEQ ID NO: 1311 - DNA, 20 bp, Artificial sequence
  Synthetic oligonucleotide
gacagggcgcacccgagagc

SEQ ID NO: 1312 - DNA, 20 bp, Artificial sequence
  Synthetic oligonucleotide
tccgcgcttgctcggcagtc

SEQ ID NO: 1313 - DNA, 20 bp, Artificial sequence
  Synthetic oligonucleotide
ccggtcgcggttcagcacga

SEQ ID NO: 1314 - DNA, 20 bp, Artificial sequence
  Synthetic oligonucleotide
gtctggcactgtgccaggtc

SEQ ID NO: 1315 - DNA, 20 bp, Artificial sequence
  Synthetic oligonucleotide
gggctgaggcttcggcggtg

SEQ ID NO: 1316 - DNA, 20 bp, Artificial sequence
  Synthetic oligonucleotide
gttcctggtcagggaaggcg

SEQ ID NO: 1317 - DNA, 20 bp, Artificial sequence
  Synthetic oligonucleotide
agacagactcttgcggagcc

SEQ ID NO: 1318 - DNA, 20 bp, Artificial sequence
  Synthetic oligonucleotide
cccagtacagcgcggcgatg

SEQ ID NO: 1319 - DNA, 20 bp, Artificial sequence
  Synthetic oligonucleotide
ccggtcctgcaggcagtgag

SEQ ID NO: 1320 - DNA, 20 bp, Artificial sequence
  Synthetic oligonucleotide
acggctcacagctgtggtta

SEQ ID NO: 1321 - DNA, 20 bp, Artificial sequence
  Synthetic oligonucleotide
ctcctgaaggcgcaacagag

SEQ ID NO: 1322 - DNA, 20 bp, Artificial sequence
  Synthetic oligonucleotide
cttggcaggcacaccggctg

SEQ ID NO: 1323 - DNA, 20 bp, Artificial sequence
  Synthetic oligonucleotide
ccccctcgaactggtggccc

SEQ ID NO: 1324 - DNA, 20 bp, Artificial sequence
  Synthetic oligonucleotide
gtacctgcgcctcctgcagg

SEQ ID NO: 1325 - DNA, 20 bp, Artificial sequence
  Synthetic oligonucleotide
tgccgccctcgaggaaccct

SEQ ID NO: 1326 - DNA, 20 bp, Artificial sequence
  Synthetic oligonucleotide
tgatgccttgcagggtgagc

SEQ ID NO: 1327 - DNA, 20 bp, Artificial sequence
  Synthetic oligonucleotide
cggtcaccacagcccgatcc

SEQ ID NO: 1328 - DNA, 20 bp, Artificial sequence
  Synthetic oligonucleotide
atccaggccaggtagtaggc

SEQ ID NO: 1329 - DNA, 20 bp, Artificial sequence
  Synthetic oligonucleotide
gatgagtccctgagcaatca

SEQ ID NO: 1330 - DNA, 20 bp, Artificial sequence
  Synthetic oligonucleotide
cccagccactctctcactgc

SEQ ID NO: 1331 - DNA, 20 bp, Artificial sequence
  Synthetic oligonucleotide
ctggcgcggagctggccgca

SEQ ID NO: 1332 - DNA, 20 bp, Artificial sequence
  Synthetic oligonucleotide
ttttcaaagcactttattga

SEQ ID NO: 1333 - DNA, 20 bp, Artificial sequence
  Synthetic oligonucleotide
tagcgaccccccagaacaat

SEQ ID NO: 1334 - DNA, 20 bp, Artificial sequence
  Synthetic oligonucleotide
cgggctggcctcacctttcc

SEQ ID NO: 1335 - DNA, 20 bp, Artificial sequence
  Synthetic oligonucleotide
tacctccccccgttgtcttc

SEQ ID NO: 1336 - DNA, 20 bp, Artificial sequence
  Synthetic oligonucleotide
tcatagcctgccaccgatct

SEQ ID NO: 1337 - DNA, 20 bp, Artificial sequence
  Synthetic oligonucleotide
acacatccccacccaagggt

SEQ ID NO: 1338 - DNA, 20 bp, Artificial sequence
  Synthetic oligonucleotide
gctcacgatcactctagtgc

SEQ ID NO: 1339 - DNA, 20 bp, Artificial sequence
  Synthetic oligonucleotide
ggaaggctggcaggagccca

SEQ ID NO: 1340 - DNA, 20 bp, Artificial sequence
  Synthetic oligonucleotide
gcttcagaggcattcagatg

SEQ ID NO: 1341 - DNA, 20 bp, Artificial sequence
  Synthetic oligonucleotide
aaccctaagaggtttactgt

SEQ ID NO: 1342 - DNA, 20 bp, Artificial sequence
  Synthetic oligonucleotide
catctaaaaggtagtttcat

SEQ ID NO: 1343 - DNA, 20 bp, Artificial sequence
  Synthetic oligonucleotide
ttcacaggccctgctatgtg

SEQ ID NO: 1344 - DNA, 20 bp, Artificial sequence
  Synthetic oligonucleotide
ggagaaacttttgggtgtgg

SEQ ID NO: 1345 - DNA, 20 bp, Artificial sequence
  Synthetic oligonucleotide
agatggacctttaagatgca

SEQ ID NO: 1346 - DNA, 20 bp, Artificial sequence
  Synthetic oligonucleotide
aagtacctgctcaataagct

SEQ ID NO: 1347 - DNA, 20 bp, Artificial sequence
  Synthetic oligonucleotide
tgtgattttatagaacataa

SEQ ID NO: 1348 - DNA, 20 bp, Artificial sequence
  Synthetic oligonucleotide
aatcagcaacacatatacta

SEQ ID NO: 1349 - DNA, 20 bp, Artificial sequence
  Synthetic oligonucleotide
tcctgctgaagagctgtgta

SEQ ID NO: 1350 - DNA, 20 bp, Artificial sequence
  Synthetic oligonucleotide
gctgctgctgcttgtttcag

SEQ ID NO: 1351 - DNA, 20 bp, Artificial sequence
  Synthetic oligonucleotide
ttttatttgtaactcccaag

SEQ ID NO: 1352 - DNA, 20 bp, Artificial sequence
  Synthetic oligonucleotide
taaccactctgatctgagcc

SEQ ID NO: 1353 - DNA, 20 bp, Artificial sequence
  Synthetic oligonucleotide
ccttgggtaagtcttcagtc

SEQ ID NO: 1354 - DNA, 20 bp, Artificial sequence
  Synthetic oligonucleotide
gtcgctgtgcattgaaaaca

SEQ ID NO: 1355 - DNA, 20 bp, Artificial sequence
  Synthetic oligonucleotide
cacactctctgaggacttcc

SEQ ID NO: 1356 - DNA, 20 bp, Artificial sequence
  Synthetic oligonucleotide
ctctccaagcagagttcctt

SEQ ID NO: 1357 - DNA, 20 bp, Artificial sequence
  Synthetic oligonucleotide
ccaccccagaggctgtgtgt

SEQ ID NO: 1358 - DNA, 20 bp, Artificial sequence
  Synthetic oligonucleotide
gaactctccctctggacttc

SEQ ID NO: 1359 - DNA, 20 bp, Artificial sequence
  Synthetic oligonucleotide
cttcttgaacctacttgcct

SEQ ID NO: 1360 - DNA, 20 bp, Artificial sequence
  Synthetic oligonucleotide
gcccaggtcctccacatctc

SEQ ID NO: 1361 - DNA, 20 bp, Artificial sequence
  Synthetic oligonucleotide
gagggatagtggtctcagga

SEQ ID NO: 1362 - DNA, 20 bp, Artificial sequence
  Synthetic oligonucleotide
agagctctccttcctggcac

SEQ ID NO: 1363 - DNA, 20 bp, Artificial sequence
  Synthetic oligonucleotide
ttcctggcaagcccgtccca

SEQ ID NO: 1364 - DNA, 20 bp, Artificial sequence
  Synthetic oligonucleotide
cccagccccacgcggcgcac

SEQ ID NO: 1365 - DNA, 20 bp, Artificial sequence
  Synthetic oligonucleotide
gacggagagcccgcggccgg

SEQ ID NO: 1366 - DNA, 20 bp, Artificial sequence
  Synthetic oligonucleotide
cgaaccccaatcccgtgttc

SEQ ID NO: 1367 - DNA, 20 bp, Artificial sequence
  Synthetic oligonucleotide
cccctgcccctagcagttgt

SEQ ID NO: 1368 - DNA, 20 bp, Artificial sequence
  Synthetic oligonucleotide
ctcacaacccatcaggtcag

SEQ ID NO: 1369 - DNA, 20 bp, Artificial sequence
  Synthetic oligonucleotide
agggaaccaagagcaagttc

SEQ ID NO: 1370 - DNA, 20 bp, Artificial sequence
  Synthetic oligonucleotide
gaatgggcggagcggaaaca

SEQ ID NO: 1371 - DNA, 20 bp, Artificial sequence
  Synthetic oligonucleotide
acccactcatgcccttcctc

SEQ ID NO: 1372 - DNA, 20 bp, Artificial sequence
  Synthetic oligonucleotide
cgccaaccgggctaagagct

SEQ ID NO: 1373 - DNA, 20 bp, Artificial sequence
  Synthetic oligonucleotide
ggtccagctgcctatccagg

SEQ ID NO: 1374 - DNA, 20 bp, Artificial sequence
  Synthetic oligonucleotide
caggaaccccaggagcagca

SEQ ID NO: 1375 - DNA, 20 bp, Artificial sequence
  Synthetic oligonucleotide
gcttcccaaggtggaatcga

SEQ ID NO: 1376 - DNA, 20 bp, Artificial sequence
  Synthetic oligonucleotide
gacagtgagaacgactgtgt

SEQ ID NO: 1377 - DNA, 20 bp, Artificial sequence
  Synthetic oligonucleotide
tttgtggtacagctgccggt

SEQ ID NO: 1378 - DNA, 20 bp, Artificial sequence
  Synthetic oligonucleotide
gtggtagcacaccagggctg

SEQ ID NO: 1379 - DNA, 20 bp, Artificial sequence
  Synthetic oligonucleotide
ttcactttcttgggctccaa

SEQ ID NO: 1380 - DNA, 20 bp, Artificial sequence
  Synthetic oligonucleotide
tggcatgttcacacaggtcc

SEQ ID NO: 1381 - DNA, 20 bp, Artificial sequence
  Synthetic oligonucleotide
ctctttctggcagtggtttc

SEQ ID NO: 1382 - DNA, 20 bp, Artificial sequence
  Synthetic oligonucleotide
cattcttgtggaaaaaccgg

SEQ ID NO: 1383 - DNA, 20 bp, Artificial sequence
  Synthetic oligonucleotide
catctggccacagctgcttg

SEQ ID NO: 1384 - DNA, 20 bp, Artificial sequence
  Synthetic oligonucleotide
ggccagccgctggcagtggg

SEQ ID NO: 1385 - DNA, 20 bp, Artificial sequence
  Synthetic oligonucleotide
ccccatggaggcacgggttg

SEQ ID NO: 1386 - DNA, 20 bp, Artificial sequence
  Synthetic oligonucleotide
agtggcacaggcggtggccc

SEQ ID NO: 1387 - DNA, 20 bp, Artificial sequence
  Synthetic oligonucleotide
ggccatcatagcagcttgcc

SEQ ID NO: 1388 - DNA, 20 bp, Artificial sequence
  Synthetic oligonucleotide
ctgacagggcgcacccgaga

SEQ ID NO: 1389 - DNA, 20 bp, Artificial sequence
  Synthetic oligonucleotide
ttccgcgcttgctcggcagt

SEQ ID NO: 1390 - DNA, 20 bp, Artificial sequence
  Synthetic oligonucleotide
gccggtcgcggttcagcacg

SEQ ID NO: 1391 - DNA, 20 bp, Artificial sequence
  Synthetic oligonucleotide
ggtctggcactgtgccaggt

SEQ ID NO: 1392 - DNA, 20 bp, Artificial sequence
  Synthetic oligonucleotide
tgggctgaggcttcggcggt

SEQ ID NO: 1393 - DNA, 20 bp, Artificial sequence
  Synthetic oligonucleotide
cgttcctggtcagggaaggc

SEQ ID NO: 1394 - DNA, 20 bp, Artificial sequence
  Synthetic oligonucleotide
aagacagactcttgcggagc

SEQ ID NO: 1395 - DNA, 20 bp, Artificial sequence
  Synthetic oligonucleotide
gccccagtacagcgcggcga

SEQ ID NO: 1396 - DNA, 20 bp, Artificial sequence
  Synthetic oligonucleotide
gccggtcctgcaggcagtga

SEQ ID NO: 1397 - DNA, 20 bp, Artificial sequence
  Synthetic oligonucleotide
cacggctcacagctgtggtt

SEQ ID NO: 1398 - DNA, 20 bp, Artificial sequence
  Synthetic oligonucleotide
tcctcctgaaggcgcaacag

SEQ ID NO: 1399 - DNA, 20 bp, Artificial sequence
  Synthetic oligonucleotide
gcttggcaggcacaccggct

SEQ ID NO: 1400 - DNA, 20 bp, Artificial sequence
  Synthetic oligonucleotide
gccccctcgaactggtggcc

SEQ ID NO: 1401 - DNA, 20 bp, Artificial sequence
  Synthetic oligonucleotide
ggtacctgcgcctcctgcag

SEQ ID NO: 1402 - DNA, 20 bp, Artificial sequence
  Synthetic oligonucleotide
cggtgccgccctcgaggaac

SEQ ID NO: 1403 - DNA, 20 bp, Artificial sequence
  Synthetic oligonucleotide
atgatgccttgcagggtgag

SEQ ID NO: 1404 - DNA, 20 bp, Artificial sequence
  Synthetic oligonucleotide
tgcggtcaccacagcccgat

SEQ ID NO: 1405 - DNA, 20 bp, Artificial sequence
  Synthetic oligonucleotide
gatccaggccaggtagtagg

SEQ ID NO: 1406 - DNA, 20 bp, Artificial sequence
  Synthetic oligonucleotide
agatgagtccctgagcaatc

SEQ ID NO: 1407 - DNA, 20 bp, Artificial sequence
  Synthetic oligonucleotide
tgccccagccactctctcac

SEQ ID NO: 1408 - DNA, 20 bp, Artificial sequence
  Synthetic oligonucleotide
cctggcgcggagctggccgc

SEQ ID NO: 1409 - DNA, 20 bp, Artificial sequence
  Synthetic oligonucleotide
attttcaaagcactttattg

SEQ ID NO: 1410 - DNA, 20 bp, Artificial sequence
  Synthetic oligonucleotide
tgatagcgaccccccagaac

SEQ ID NO: 1411 - DNA, 20 bp, Artificial sequence
  Synthetic oligonucleotide
gccttccgggctggcctcac

SEQ ID NO: 1412 - DNA, 20 bp, Artificial sequence
  Synthetic oligonucleotide
ttctacctccccccgttgtc

SEQ ID NO: 1413 - DNA, 20 bp, Artificial sequence
  Synthetic oligonucleotide
aagtcatagcctgccaccga

SEQ ID NO: 1414 - DNA, 20 bp, Artificial sequence
  Synthetic oligonucleotide
catacacatccccacccaag

SEQ ID NO: 1415 - DNA, 20 bp, Artificial sequence
  Synthetic oligonucleotide
acagctcacgatcactctag

SEQ ID NO: 1416 - DNA, 20 bp, Artificial sequence
  Synthetic oligonucleotide
tgaggaaggctggcaggagc

SEQ ID NO: 1417 - DNA, 20 bp, Artificial sequence
  Synthetic oligonucleotide
tgggcttcagaggcattcag

SEQ ID NO: 1418 - DNA, 20 bp, Artificial sequence
  Synthetic oligonucleotide
aacaaccctaagaggtttac

SEQ ID NO: 1419 - DNA, 20 bp, Artificial sequence
  Synthetic oligonucleotide
cttcatctaaaaggtagttt

SEQ ID NO: 1420 - DNA, 20 bp, Artificial sequence
  Synthetic oligonucleotide
tggttcacaggccctgctat

SEQ ID NO: 1421 - DNA, 20 bp, Artificial sequence
  Synthetic oligonucleotide
agaggagaaacttttgggtg

SEQ ID NO: 1422 - DNA, 20 bp, Artificial sequence
  Synthetic oligonucleotide
ctgagatggacctttaagat

SEQ ID NO: 1423 - DNA, 20 bp, Artificial sequence
  Synthetic oligonucleotide
tggcacaaagtacctgctca

SEQ ID NO: 1424 - DNA, 20 bp, Artificial sequence
  Synthetic oligonucleotide
cactgtgattttatagaaca

SEQ ID NO: 1425 - DNA, 20 bp, Artificial sequence
  Synthetic oligonucleotide
atgaatcagcaacacatata

SEQ ID NO: 1426 - DNA, 20 bp, Artificial sequence
  Synthetic oligonucleotide
gcctcctgctgaagagctgt

SEQ ID NO: 1427 - DNA, 20 bp, Artificial sequence
  Synthetic oligonucleotide
cacgctgctgctgcttgttt

SEQ ID NO: 1428 - DNA, 20 bp, Artificial sequence
  Synthetic oligonucleotide
gaattttatttgtaactccc

SEQ ID NO: 1429 - DNA, 20 bp, Artificial sequence
  Synthetic oligonucleotide
tgttaaccactctgatctga

SEQ ID NO: 1430 - DNA, 20 bp, Artificial sequence
  Synthetic oligonucleotide
tgaccttgggtaagtcttca

SEQ ID NO: 1431 - DNA, 20 bp, Artificial sequence
  Synthetic oligonucleotide
aaggtcgctgtgcattgaaa

SEQ ID NO: 1432 - DNA, 20 bp, Artificial sequence
  Synthetic oligonucleotide
caacacactctctgaggact

SEQ ID NO: 1433 - DNA, 20 bp, Artificial sequence
  Synthetic oligonucleotide
cctctctccaagcagagttc

SEQ ID NO: 1434 - DNA, 20 bp, Artificial sequence
  Synthetic oligonucleotide
aggccaccccagaggctgtg

SEQ ID NO: 1435 - DNA, 20 bp, Artificial sequence
  Synthetic oligonucleotide
ccagaactctccctctggac

SEQ ID NO: 1436 - DNA, 20 bp, Artificial sequence
  Synthetic oligonucleotide
gcccttcttgaacctacttg

SEQ ID NO: 1437 - DNA, 20 bp, Artificial sequence
  Synthetic oligonucleotide
cccgcccaggtcctccacat

SEQ ID NO: 1438 - DNA, 20 bp, Artificial sequence
  Synthetic oligonucleotide
aaagagggatagtggtctca

SEQ ID NO: 1439 - DNA, 20 bp, Artificial sequence
  Synthetic oligonucleotide
cagagagctctccttcctgg

SEQ ID NO: 1440 - DNA, 20 bp, Artificial sequence
  Synthetic oligonucleotide
tccttcctggcaagcccgtc

SEQ ID NO: 1441 - DNA, 20 bp, Artificial sequence
  Synthetic oligonucleotide
tcacccagccccacgcggcg

SEQ ID NO: 1442 - DNA, 20 bp, Artificial sequence
  Synthetic oligonucleotide
gaggacggagagcccgcggc

SEQ ID NO: 1443 - DNA, 20 bp, Artificial sequence
  Synthetic oligonucleotide
tcccgaaccccaatcccgtg

SEQ ID NO: 1444 - DNA, 20 bp, Artificial sequence
  Synthetic oligonucleotide
ctacccctgcccctagcagt

SEQ ID NO: 1445 - DNA, 20 bp, Artificial sequence
  Synthetic oligonucleotide
attctcacaacccatcaggt

SEQ ID NO: 1446 - DNA, 20 bp, Artificial sequence
  Synthetic oligonucleotide
gcccagagggaaccaagagc

SEQ ID NO: 1447 - DNA, 20 bp, Artificial sequence
  Synthetic oligonucleotide
tttgaatgggcggagcggaa

SEQ ID NO: 1448 - DNA, 20 bp, Artificial sequence
  Synthetic oligonucleotide
taaacccactcatgcccttc

SEQ ID NO: 1449 - DNA, 20 bp, Artificial sequence
  Synthetic oligonucleotide
ttgtgcctgacggcctcggg

SEQ ID NO: 1450 - DNA, 20 bp, Artificial sequence
  Synthetic oligonucleotide
tccagctgcctatccaggag

SEQ ID NO: 1451 - DNA, 20 bp, Artificial sequence
  Synthetic oligonucleotide
caggagcagcagagccctca

SEQ ID NO: 1452 - DNA, 20 bp, Artificial sequence
  Synthetic oligonucleotide
ccaaggtggaatcgaaagtg

SEQ ID NO: 1453 - DNA, 20 bp, Artificial sequence
  Synthetic oligonucleotide
agtgagaacgactgtgtgct

SEQ ID NO: 1454 - DNA, 20 bp, Artificial sequence
  Synthetic oligonucleotide
gtggtacagctgccggtggt

SEQ ID NO: 1455 - DNA, 20 bp, Artificial sequence
  Synthetic oligonucleotide
ggctgagggcctggccggcc

SEQ ID NO: 1456 - DNA, 20 bp, Artificial sequence
  Synthetic oligonucleotide
cactttcttgggctccaaac

SEQ ID NO: 1457 - DNA, 20 bp, Artificial sequence
  Synthetic oligonucleotide
gcatgttcacacaggtccct

SEQ ID NO: 1458 - DNA, 20 bp, Artificial sequence
  Synthetic oligonucleotide
ctttctggcagtggtttcca

SEQ ID NO: 1459 - DNA, 20 bp, Artificial sequence
  Synthetic oligonucleotide
ttcttgtggaaaaaccggag

SEQ ID NO: 1460 - DNA, 20 bp, Artificial sequence
  Synthetic oligonucleotide
tctggccacagctgcttgct

SEQ ID NO: 1461 - DNA, 20 bp, Artificial sequence
  Synthetic oligonucleotide
ccagccgctggcagtgggca

SEQ ID NO: 1462 - DNA, 20 bp, Artificial sequence
  Synthetic oligonucleotide
catggaggcacgggttggtg

SEQ ID NO: 1463 - DNA, 20 bp, Artificial sequence
  Synthetic oligonucleotide
ggcacaggcggtggccctcc

SEQ ID NO: 1464 - DNA, 20 bp, Artificial sequence
  Synthetic oligonucleotide
catcatagcagcttgccttg

SEQ ID NO: 1465 - DNA, 20 bp, Artificial sequence
  Synthetic oligonucleotide
acagggcgcacccgagagcg

SEQ ID NO: 1466 - DNA, 20 bp, Artificial sequence
  Synthetic oligonucleotide
ccgcgcttgctcggcagtca

SEQ ID NO: 1467 - DNA, 20 bp, Artificial sequence
  Synthetic oligonucleotide
gcggttcagcacgaagcacc

SEQ ID NO: 1468 - DNA, 20 bp, Artificial sequence
  Synthetic oligonucleotide
tctggcactgtgccaggtcg

SEQ ID NO: 1469 - DNA, 20 bp, Artificial sequence
  Synthetic oligonucleotide
ggctgaggcttcggcggtgc

SEQ ID NO: 1470 - DNA, 20 bp, Artificial sequence
  Synthetic oligonucleotide
ttcctggtcagggaaggcgg

SEQ ID NO: 1471 - DNA, 20 bp, Artificial sequence
  Synthetic oligonucleotide
gacagactcttgcggagccg

SEQ ID NO: 1472 - DNA, 20 bp, Artificial sequence
  Synthetic oligonucleotide
ccagtacagcgcggcgatgt

SEQ ID NO: 1473 - DNA, 20 bp, Artificial sequence
  Synthetic oligonucleotide
cggtcctgcaggcagtgagc

SEQ ID NO: 1474 - DNA, 20 bp, Artificial sequence
  Synthetic oligonucleotide
cggctcacagctgtggttac

SEQ ID NO: 1475 - DNA, 20 bp, Artificial sequence
  Synthetic oligonucleotide
tcctgaaggcgcaacagagc

SEQ ID NO: 1476 - DNA, 20 bp, Artificial sequence
  Synthetic oligonucleotide
tggcaggcacaccggctgaa

SEQ ID NO: 1477 - DNA, 20 bp, Artificial sequence
  Synthetic oligonucleotide
cccctcgaactggtggcccc

SEQ ID NO: 1478 - DNA, 20 bp, Artificial sequence
  Synthetic oligonucleotide
acctgcgcctcctgcaggaa

SEQ ID NO: 1479 - DNA, 20 bp, Artificial sequence
  Synthetic oligonucleotide
ccgccctcgaggaaccctgc

SEQ ID NO: 1480 - DNA, 20 bp, Artificial sequence
  Synthetic oligonucleotide
atgccttgcagggtgagccg

SEQ ID NO: 1481 - DNA, 20 bp, Artificial sequence
  Synthetic oligonucleotide
ggtcaccacagcccgatccc

SEQ ID NO: 1482 - DNA, 20 bp, Artificial sequence
  Synthetic oligonucleotide
tccaggccaggtagtaggcc

SEQ ID NO: 1483 - DNA, 20 bp, Artificial sequence
  Synthetic oligonucleotide
atgagtccctgagcaatcag

SEQ ID NO: 1484 - DNA, 20 bp, Artificial sequence
  Synthetic oligonucleotide
cagccactctctcactgcgg

SEQ ID NO: 1485 - DNA, 20 bp, Artificial sequence
  Synthetic oligonucleotide
gcgcggagctggccgcactg

SEQ ID NO: 1486 - DNA, 20 bp, Artificial sequence
  Synthetic oligonucleotide
ttcaaagcactttattgagt

SEQ ID NO: 1487 - DNA, 20 bp, Artificial sequence
  Synthetic oligonucleotide
cgaccccccagaacaatcct

SEQ ID NO: 1488 - DNA, 20 bp, Artificial sequence
  Synthetic oligonucleotide
gctggcctcacctttccaca

SEQ ID NO: 1489 - DNA, 20 bp, Artificial sequence
  Synthetic oligonucleotide
ctccccccgttgtcttctta

SEQ ID NO: 1490 - DNA, 20 bp, Artificial sequence
  Synthetic oligonucleotide
tagcctgccaccgatctgtt

SEQ ID NO: 1491 - DNA, 20 bp, Artificial sequence
  Synthetic oligonucleotide
catccccacccaagggttcc

SEQ ID NO: 1492 - DNA, 20 bp, Artificial sequence
  Synthetic oligonucleotide
cacgatcactctagtgccca

SEQ ID NO: 1493 - DNA, 20 bp, Artificial sequence
  Synthetic oligonucleotide
aggctggcaggagcccaggt

SEQ ID NO: 1494 - DNA, 20 bp, Artificial sequence
  Synthetic oligonucleotide
gaggcattcagatgccagag

SEQ ID NO: 1495 - DNA, 20 bp, Artificial sequence
  Synthetic oligonucleotide
cctaagaggtttactgttat

SEQ ID NO: 1496 - DNA, 20 bp, Artificial sequence
  Synthetic oligonucleotide
ctaaaaggtagtttcataat

SEQ ID NO: 1497 - DNA, 20 bp, Artificial sequence
  Synthetic oligonucleotide
acaggccctgctatgtgcca

SEQ ID NO: 1498 - DNA, 20 bp, Artificial sequence
  Synthetic oligonucleotide
ggtgaagagaggaggctgag

SEQ ID NO: 1499 - DNA, 20 bp, Artificial sequence
  Synthetic oligonucleotide
tggacctttaagatgcaaat

SEQ ID NO: 1500 - DNA, 20 bp, Artificial sequence
  Synthetic oligonucleotide
tacctgctcaataagctttt

SEQ ID NO: 1501 - DNA, 20 bp, Artificial sequence
  Synthetic oligonucleotide
attttatagaacataaccat

SEQ ID NO: 1502 - DNA, 20 bp, Artificial sequence
  Synthetic oligonucleotide
aacacatatactaaataaaa

SEQ ID NO: 1503 - DNA, 20 bp, Artificial sequence
  Synthetic oligonucleotide
tgctgaagagctgtgtagtt

SEQ ID NO: 1504 - DNA, 20 bp, Artificial sequence
  Synthetic oligonucleotide
gctgctgcttgtttcagctc

SEQ ID NO: 1505 - DNA, 20 bp, Artificial sequence
  Synthetic oligonucleotide
tatttgtaactcccaagtca

SEQ ID NO: 1506 - DNA, 20 bp, Artificial sequence
  Synthetic oligonucleotide
ccactctgatctgagccttg

SEQ ID NO: 1507 - DNA, 20 bp, Artificial sequence
  Synthetic oligonucleotide
tgggtaagtcttcagtccca

SEQ ID NO: 1508 - DNA, 20 bp, Artificial sequence
  Synthetic oligonucleotide
gctgtgcattgaaaacactt

SEQ ID NO: 1509 - DNA, 20 bp, Artificial sequence
  Synthetic oligonucleotide
actctctgaggacttcccct

SEQ ID NO: 1510 - DNA, 20 bp, Artificial sequence
  Synthetic oligonucleotide
tccaagcagagttccttgga

SEQ ID NO: 1511 - DNA, 20 bp, Artificial sequence
  Synthetic oligonucleotide
ccccagaggctgtgtgtagc

SEQ ID NO: 1512 - DNA, 20 bp, Artificial sequence
  Synthetic oligonucleotide
ctctccctctggacttccaa

SEQ ID NO: 1513 - DNA, 20 bp, Artificial sequence
  Synthetic oligonucleotide
cttgaacctacttgccttgt

SEQ ID NO: 1514 - DNA, 20 bp, Artificial sequence
  Synthetic oligonucleotide
caggtcctccacatctcctc

SEQ ID NO: 1515 - DNA, 20 bp, Artificial sequence
  Synthetic oligonucleotide
ggatagtggtctcaggagag

SEQ ID NO: 1516 - DNA, 20 bp, Artificial sequence
  Synthetic oligonucleotide
gctctccttcctggcacacc

SEQ ID NO: 1517 - DNA, 20 bp, Artificial sequence
  Synthetic oligonucleotide
ctggcaagcccgtcccacct

SEQ ID NO: 1518 - DNA, 20 bp, Artificial sequence
  Synthetic oligonucleotide
agccccacgcggcgcaccgg

SEQ ID NO: 1519 - DNA, 20 bp, Artificial sequence
  Synthetic oligonucleotide
ggagagcccgcggccggctg

SEQ ID NO: 1520 - DNA, 20 bp, Artificial sequence
  Synthetic oligonucleotide
accccaatcccgtgttccag

SEQ ID NO: 1521 - DNA, 20 bp, Artificial sequence
  Synthetic oligonucleotide
ctgcccctagcagttgtgcc

SEQ ID NO: 1522 - DNA, 20 bp, Artificial sequence
  Synthetic oligonucleotide
acaacccatcaggtcagcgc

SEQ ID NO: 1523 - DNA, 20 bp, Artificial sequence
  Synthetic oligonucleotide
gaaccaagagcaagttcgat

SEQ ID NO: 1524 - DNA, 20 bp, Artificial sequence
  Synthetic oligonucleotide
tgggcggagcggaaacagaa

SEQ ID NO: 1525 - DNA, 20 bp, Artificial sequence
  Synthetic oligonucleotide
cactcatgcccttcctctct

SEQ ID NO: 1526 - DNA, 20 bp, Artificial sequence
  Synthetic oligonucleotide
caaccgggctaagagctcac

SEQ ID NO: 1527 - DNA, 20 bp, Artificial sequence
  Synthetic oligonucleotide
ttggtccagctgcctatcca

SEQ ID NO: 1528 - DNA, 20 bp, Artificial sequence
  Synthetic oligonucleotide
accagcaggaaccccaggag

SEQ ID NO: 1529 - DNA, 20 bp, Artificial sequence
  Synthetic oligonucleotide
gggcttcccaaggtggaatc

SEQ ID NO: 1530 - DNA, 20 bp, Artificial sequence
  Synthetic oligonucleotide
tgacagtgagaacgactgtg

SEQ ID NO: 1531 - DNA, 20 bp, Artificial sequence
  Synthetic oligonucleotide
atttgtggtacagctgccgg

SEQ ID NO: 1532 - DNA, 20 bp, Artificial sequence
  Synthetic oligonucleotide
ggtggtagcacaccagggct

SEQ ID NO: 1533 - DNA, 20 bp, Artificial sequence
  Synthetic oligonucleotide
ctttcactttcttgggctcc

SEQ ID NO: 1534 - DNA, 20 bp, Artificial sequence
  Synthetic oligonucleotide
cttggcatgttcacacaggt

SEQ ID NO: 1535 - DNA, 20 bp, Artificial sequence
  Synthetic oligonucleotide
tctctttctggcagtggttt

SEQ ID NO: 1536 - DNA, 20 bp, Artificial sequence
  Synthetic oligonucleotide
tcattcttgtggaaaaaccg

SEQ ID NO: 1537 - DNA, 20 bp, Artificial sequence
  Synthetic oligonucleotide
gcatctggccacagctgctt

SEQ ID NO: 1538 - DNA, 20 bp, Artificial sequence
  Synthetic oligonucleotide
tggccagccgctggcagtgg

SEQ ID NO: 1539 - DNA, 20 bp, Artificial sequence
  Synthetic oligonucleotide
gcagtggcacaggcggtggc

SEQ ID NO: 1540 - DNA, 20 bp, Artificial sequence
  Synthetic oligonucleotide
gcggccatcatagcagcttg

SEQ ID NO: 1541 - DNA, 20 bp, Artificial sequence
  Synthetic oligonucleotide
gctgacagggcgcacccgag

SEQ ID NO: 1542 - DNA, 20 bp, Artificial sequence
  Synthetic oligonucleotide
gttccgcgcttgctcggcag

SEQ ID NO: 1543 - DNA, 20 bp, Artificial sequence
  Synthetic oligonucleotide
agccggtcgcggttcagcac

SEQ ID NO: 1544 - DNA, 20 bp, Artificial sequence
  Synthetic oligonucleotide
gggtctggcactgtgccagg

SEQ ID NO: 1545 - DNA, 20 bp, Artificial sequence
  Synthetic oligonucleotide
gtgggctgaggcttcggcgg

SEQ ID NO: 1546 - DNA, 20 bp, Artificial sequence
  Synthetic oligonucleotide
ccgttcctggtcagggaagg

SEQ ID NO: 1547 - DNA, 20 bp, Artificial sequence
  Synthetic oligonucleotide
gaagacagactcttgcggag

SEQ ID NO: 1548 - DNA, 20 bp, Artificial sequence
  Synthetic oligonucleotide
ggccccagtacagcgcggcg

SEQ ID NO: 1549 - DNA, 20 bp, Artificial sequence
  Synthetic oligonucleotide
gggccggtcctgcaggcagt

SEQ ID NO: 1550 - DNA, 20 bp, Artificial sequence
  Synthetic oligonucleotide
gcacggctcacagctgtggt

SEQ ID NO: 1551 - DNA, 20 bp, Artificial sequence
  Synthetic oligonucleotide
atcctcctgaaggcgcaaca

SEQ ID NO: 1552 - DNA, 20 bp, Artificial sequence
  Synthetic oligonucleotide
ccgcttggcaggcacaccgg

SEQ ID NO: 1553 - DNA, 20 bp, Artificial sequence
  Synthetic oligonucleotide
cgccccctcgaactggtggc

SEQ ID NO: 1554 - DNA, 20 bp, Artificial sequence
  Synthetic oligonucleotide
cggtacctgcgcctcctgca

SEQ ID NO: 1555 - DNA, 20 bp, Artificial sequence
  Synthetic oligonucleotide
tcggtgccgccctcgaggaa

SEQ ID NO: 1556 - DNA, 20 bp, Artificial sequence
  Synthetic oligonucleotide
gatgatgccttgcagggtga

SEQ ID NO: 1557 - DNA, 20 bp, Artificial sequence
  Synthetic oligonucleotide
ttgcggtcaccacagcccga

SEQ ID NO: 1558 - DNA, 20 bp, Artificial sequence
  Synthetic oligonucleotide
ggatccaggccaggtagtag

SEQ ID NO: 1559 - DNA, 20 bp, Artificial sequence
  Synthetic oligonucleotide
aagatgagtccctgagcaat

SEQ ID NO: 1560 - DNA, 20 bp, Artificial sequence
  Synthetic oligonucleotide
atgccccagccactctctca

SEQ ID NO: 1561 - DNA, 20 bp, Artificial sequence
  Synthetic oligonucleotide
tcctggcgcggagctggccg

SEQ ID NO: 1562 - DNA, 20 bp, Artificial sequence
  Synthetic oligonucleotide
gcattttcaaagcactttat

SEQ ID NO: 1563 - DNA, 20 bp, Artificial sequence
  Synthetic oligonucleotide
ctgtgatagcgaccccccag

SEQ ID NO: 1564 - DNA, 20 bp, Artificial sequence
  Synthetic oligonucleotide
tcctctgcctgggccttccg

SEQ ID NO: 1565 - DNA, 20 bp, Artificial sequence
  Synthetic oligonucleotide
cctttctacctccccccgtt

SEQ ID NO: 1566 - DNA, 20 bp, Artificial sequence
  Synthetic oligonucleotide
tataagtcatagcctgccac

SEQ ID NO: 1567 - DNA, 20 bp, Artificial sequence
  Synthetic oligonucleotide
caccatacacatccccaccc

SEQ ID NO: 1568 - DNA, 20 bp, Artificial sequence
  Synthetic oligonucleotide
cacacagctcacgatcactc

SEQ ID NO: 1569 - DNA, 20 bp, Artificial sequence
  Synthetic oligonucleotide
aactgaggaaggctggcagg

SEQ ID NO: 1570 - DNA, 20 bp, Artificial sequence
  Synthetic oligonucleotide
taaagctgggcttcagaggc

SEQ ID NO: 1571 - DNA, 20 bp, Artificial sequence
  Synthetic oligonucleotide
ctcaacaaccctaagaggtt

SEQ ID NO: 1572 - DNA, 20 bp, Artificial sequence
  Synthetic oligonucleotide
acccttcatctaaaaggtag

SEQ ID NO: 1573 - DNA, 20 bp, Artificial sequence
  Synthetic oligonucleotide
atctggttcacaggccctgc

SEQ ID NO: 1574 - DNA, 20 bp, Artificial sequence
  Synthetic oligonucleotide
gagagaggagaaacttttgg

SEQ ID NO: 1575 - DNA, 20 bp, Artificial sequence
  Synthetic oligonucleotide
gatctgagatggacctttaa

SEQ ID NO: 1576 - DNA, 20 bp, Artificial sequence
  Synthetic oligonucleotide
gtctggcacaaagtacctgc

SEQ ID NO: 1577 - DNA, 20 bp, Artificial sequence
  Synthetic oligonucleotide
aatgttcactgtgattttat

SEQ ID NO: 1578 - DNA, 20 bp, Artificial sequence
  Synthetic oligonucleotide
ttgatgaatcagcaacacat

SEQ ID NO: 1579 - DNA, 20 bp, Artificial sequence
  Synthetic oligonucleotide
tgagcctcctgctgaagagc

SEQ ID NO: 1580 - DNA, 20 bp, Artificial sequence
  Synthetic oligonucleotide
cgtcacgctgctgctgcttg

SEQ ID NO: 1581 - DNA, 20 bp, Artificial sequence
  Synthetic oligonucleotide
gctgaattttatttgtaact

SEQ ID NO: 1582 - DNA, 20 bp, Artificial sequence
  Synthetic oligonucleotide
cactgttaaccactctgatc

SEQ ID NO: 1583 - DNA, 20 bp, Artificial sequence
  Synthetic oligonucleotide
acaacctgctagctgtgtga

SEQ ID NO: 1584 - DNA, 20 bp, Artificial sequence
  Synthetic oligonucleotide
aaaaaggtcgctgtgcattg

SEQ ID NO: 1585 - DNA, 20 bp, Artificial sequence
  Synthetic oligonucleotide
ggacaacacactctctgagg

SEQ ID NO: 1586 - DNA, 20 bp, Artificial sequence
  Synthetic oligonucleotide
tcccctctctccaagcagag

SEQ ID NO: 1587 - DNA, 20 bp, Artificial sequence
  Synthetic oligonucleotide
ccccaggccaccccagaggc

SEQ ID NO: 1588 - DNA, 20 bp, Artificial sequence
  Synthetic oligonucleotide
ttcccagaactctccctctg

SEQ ID NO: 1589 - DNA, 20 bp, Artificial sequence
  Synthetic oligonucleotide
aaggcccttcttgaacctac

SEQ ID NO: 1590 - DNA, 20 bp, Artificial sequence
  Synthetic oligonucleotide
caccccgcccaggtcctcca

SEQ ID NO: 1591 - DNA, 20 bp, Artificial sequence
  Synthetic oligonucleotide
gctcaaagcacttctctggg

SEQ ID NO: 1592 - DNA, 20 bp, Artificial sequence
  Synthetic oligonucleotide
ccccagagagctctccttcc

SEQ ID NO: 1593 - DNA, 20 bp, Artificial sequence
  Synthetic oligonucleotide
ctcctccttcctggcaagcc

SEQ ID NO: 1594 - DNA, 20 bp, Artificial sequence
  Synthetic oligonucleotide
gggtcacccagccccacgcg

SEQ ID NO: 1595 - DNA, 20 bp, Artificial sequence
  Synthetic oligonucleotide
gctgaggacggagagcccgc

SEQ ID NO: 1596 - DNA, 20 bp, Artificial sequence
  Synthetic oligonucleotide
tgctcccgaaccccaatccc

SEQ ID NO: 1597 - DNA, 20 bp, Artificial sequence
  Synthetic oligonucleotide
cccctacccctgcccctagc

SEQ ID NO: 1598 - DNA, 20 bp, Artificial sequence
  Synthetic oligonucleotide
cacattctcacaacccatca

SEQ ID NO: 1599 - DNA, 20 bp, Artificial sequence
  Synthetic oligonucleotide
tggcctttgcagcccggcgc

SEQ ID NO: 1600 - DNA, 20 bp, Artificial sequence
  Synthetic oligonucleotide
ggatttgaatgggcggagcg

SEQ ID NO: 1601 - DNA, 20 bp, Artificial sequence
  Synthetic oligonucleotide
ttgtaaacccactcatgccc

SEQ ID NO: 1602 - DNA, 20 bp, Artificial sequence
  Synthetic oligonucleotide
gatttgtgcctgacggcctc

SEQ ID NO: 1603 - DNA, 20 bp, Artificial sequence
  Synthetic oligonucleotide
caccagcaggaaccccagga

SEQ ID NO: 1604 - DNA, 20 bp, Artificial sequence
  Synthetic oligonucleotide
ttgtacttatgctccttggg

SEQ ID NO: 1605 - DNA, 20 bp, Artificial sequence
  Synthetic oligonucleotide
gtgacagtgagaacgactgt

SEQ ID NO: 1606 - DNA, 20 bp, Artificial sequence
  Synthetic oligonucleotide
catttgtggtacagctgccg

SEQ ID NO: 1607 - DNA, 20 bp, Artificial sequence
  Synthetic oligonucleotide
tggtcctgatcaaagttggg

SEQ ID NO: 1608 - DNA, 20 bp, Artificial sequence
  Synthetic oligonucleotide
tctttcactttcttgggctc

SEQ ID NO: 1609 - DNA, 20 bp, Artificial sequence
  Synthetic oligonucleotide
gcttggcatgttcacacagg

SEQ ID NO: 1610 - DNA, 20 bp, Artificial sequence
  Synthetic oligonucleotide
ttctctttctggcagtggtt

SEQ ID NO: 1611 - DNA, 20 bp, Artificial sequence
  Synthetic oligonucleotide
ctcattcttgtggaaaaacc

SEQ ID NO: 1612 - DNA, 20 bp, Artificial sequence
  Synthetic oligonucleotide
ggcatctggccacagctgct

SEQ ID NO: 1613 - DNA, 20 bp, Artificial sequence
  Synthetic oligonucleotide
ctggccagccgctggcagtg

SEQ ID NO: 1614 - DNA, 20 bp, Artificial sequence
  Synthetic oligonucleotide
acccccatggaggcacgggt

SEQ ID NO: 1615 - DNA, 20 bp, Artificial sequence
  Synthetic oligonucleotide
ggcagtggcacaggcggtgg

SEQ ID NO: 1616 - DNA, 20 bp, Artificial sequence
  Synthetic oligonucleotide
cccgcggccatcatagcagc

SEQ ID NO: 1617 - DNA, 20 bp, Artificial sequence
  Synthetic oligonucleotide
ggctgacagggcgcacccga

SEQ ID NO: 1618 - DNA, 20 bp, Artificial sequence
  Synthetic oligonucleotide
agttccgcgcttgctcggca

SEQ ID NO: 1619 - DNA, 20 bp, Artificial sequence
  Synthetic oligonucleotide
tcagccggtcgcggttcagc

SEQ ID NO: 1620 - DNA, 20 bp, Artificial sequence
  Synthetic oligonucleotide
agtgggacatgaagcctagg

SEQ ID NO: 1621 - DNA, 20 bp, Artificial sequence
  Synthetic oligonucleotide
tcgccggcaaggctcccggg

SEQ ID NO: 1622 - DNA, 20 bp, Artificial sequence
  Synthetic oligonucleotide
gccgttcctggtcagggaag

SEQ ID NO: 1623 - DNA, 20 bp, Artificial sequence
  Synthetic oligonucleotide
tcgaagacagactcttgcgg

SEQ ID NO: 1624 - DNA, 20 bp, Artificial sequence
  Synthetic oligonucleotide
gtggccccagtacagcgcgg

SEQ ID NO: 1625 - DNA, 20 bp, Artificial sequence
  Synthetic oligonucleotide
cgggccggtcctgcaggcag

SEQ ID NO: 1626 - DNA, 20 bp, Artificial sequence
  Synthetic oligonucleotide
tctggcacggctcacagctg

SEQ ID NO: 1627 - DNA, 20 bp, Artificial sequence
  Synthetic oligonucleotide
catcctcctgaaggcgcaac

SEQ ID NO: 1628 - DNA, 20 bp, Artificial sequence
  Synthetic oligonucleotide
gccgcttggcaggcacaccg

SEQ ID NO: 1629 - DNA, 20 bp, Artificial sequence
  Synthetic oligonucleotide
ccgccccctcgaactggtgg

SEQ ID NO: 1630 - DNA, 20 bp, Artificial sequence
  Synthetic oligonucleotide
ggaacggtacctgcgcctcc

SEQ ID NO: 1631 - DNA, 20 bp, Artificial sequence
  Synthetic oligonucleotide
atcggtgccgccctcgagga

SEQ ID NO: 1632 - DNA, 20 bp, Artificial sequence
  Synthetic oligonucleotide
tgatgatgccttgcagggtg

SEQ ID NO: 1633 - DNA, 20 bp, Artificial sequence
  Synthetic oligonucleotide
gttgcggtcaccacagcccg

SEQ ID NO: 1634 - DNA, 20 bp, Artificial sequence
  Synthetic oligonucleotide
ccggatccaggccaggtagt

SEQ ID NO: 1635 - DNA, 20 bp, Artificial sequence
  Synthetic oligonucleotide
aaagatgagtccctgagcaa

SEQ ID NO: 1636 - DNA, 20 bp, Artificial sequence
  Synthetic oligonucleotide
catgccccagccactctctc

SEQ ID NO: 1637 - DNA, 20 bp, Artificial sequence
  Synthetic oligonucleotide
catcctggcgcggagctggc

SEQ ID NO: 1638 - DNA, 20 bp, Artificial sequence
  Synthetic oligonucleotide
tggctgtgatagcgaccccc

SEQ ID NO: 1639 - DNA, 20 bp, Artificial sequence
  Synthetic oligonucleotide
gtctcctctgcctgggcctt

SEQ ID NO: 1640 - DNA, 20 bp, Artificial sequence
  Synthetic oligonucleotide
aaccctttctacctcccccc

SEQ ID NO: 1641 - DNA, 20 bp, Artificial sequence
  Synthetic oligonucleotide
gactataagtcatagcctgc

SEQ ID NO: 1642 - DNA, 20 bp, Artificial sequence
  Synthetic oligonucleotide
ctgcaccatacacatcccca

SEQ ID NO: 1643 - DNA, 20 bp, Artificial sequence
  Synthetic oligonucleotide
gatcacacagctcacgatca

SEQ ID NO: 1644 - DNA, 20 bp, Artificial sequence
  Synthetic oligonucleotide
ggaaactgaggaaggctggc

SEQ ID NO: 1645 - DNA, 20 bp, Artificial sequence
  Synthetic oligonucleotide
tgataaagctgggcttcaga

SEQ ID NO: 1646 - DNA, 20 bp, Artificial sequence
  Synthetic oligonucleotide
ccttctcaacaaccctaaga

SEQ ID NO: 1647 - DNA, 20 bp, Artificial sequence
  Synthetic oligonucleotide
ggtacccttcatctaaaagg

SEQ ID NO: 1648 - DNA, 20 bp, Artificial sequence
  Synthetic oligonucleotide
tccatctggttcacaggccc

SEQ ID NO: 1649 - DNA, 20 bp, Artificial sequence
  Synthetic oligonucleotide
caagagagaggagaaacttt

SEQ ID NO: 1650 - DNA, 20 bp, Artificial sequence
  Synthetic oligonucleotide
atggatctgagatggacctt

SEQ ID NO: 1651 - DNA, 20 bp, Artificial sequence
  Synthetic oligonucleotide
agtgtctggcacaaagtacc

SEQ ID NO: 1652 - DNA, 20 bp, Artificial sequence
  Synthetic oligonucleotide
ttcaatgttcactgtgattt

SEQ ID NO: 1653 - DNA, 20 bp, Artificial sequence
  Synthetic oligonucleotide
gcattgatgaatcagcaaca

SEQ ID NO: 1654 - DNA, 20 bp, Artificial sequence
  Synthetic oligonucleotide
ctctgagcctcctgctgaag

SEQ ID NO: 1655 - DNA, 20 bp, Artificial sequence
  Synthetic oligonucleotide
agttaaggttcaacaaggcg

SEQ ID NO: 1656 - DNA, 20 bp, Artificial sequence
  Synthetic oligonucleotide
gtgcctacttgctgaatttt

SEQ ID NO: 1657 - DNA, 20 bp, Artificial sequence
  Synthetic oligonucleotide
agtcactgttaaccactctg

SEQ ID NO: 1658 - DNA, 20 bp, Artificial sequence
  Synthetic oligonucleotide
tccacaacctgctagctgtg

SEQ ID NO: 1659 - DNA, 20 bp, Artificial sequence
  Synthetic oligonucleotide
ctcaaaaaggtcgctgtgca

SEQ ID NO: 1660 - DNA, 20 bp, Artificial sequence
  Synthetic oligonucleotide
cagggacaacacactctctg

SEQ ID NO: 1661 - DNA, 20 bp, Artificial sequence
  Synthetic oligonucleotide
cagtcccctctctccaagca

SEQ ID NO: 1662 - DNA, 20 bp, Artificial sequence
  Synthetic oligonucleotide
agagccccaggccaccccag

SEQ ID NO: 1663 - DNA, 20 bp, Artificial sequence
  Synthetic oligonucleotide
tccttcccagaactctccct

SEQ ID NO: 1664 - DNA, 20 bp, Artificial sequence
  Synthetic oligonucleotide
gccaaggcccttcttgaacc

SEQ ID NO: 1665 - DNA, 20 bp, Artificial sequence
  Synthetic oligonucleotide
cagcaccccgcccaggtcct

SEQ ID NO: 1666 - DNA, 20 bp, Artificial sequence
  Synthetic oligonucleotide
ccctggctggccagccgctg

SEQ ID NO: 1667 - DNA, 20 bp, Artificial sequence
  Synthetic oligonucleotide
cccccccagagagctctcct

SEQ ID NO: 1668 - DNA, 20 bp, Artificial sequence
  Synthetic oligonucleotide
tccctcctccttcctggcaa

SEQ ID NO: 1669 - DNA, 20 bp, Artificial sequence
  Synthetic oligonucleotide
ccgggagcccggagccctgg

SEQ ID NO: 1670 - DNA, 20 bp, Artificial sequence
  Synthetic oligonucleotide
aaggctgtggaggagcaggg

SEQ ID NO: 1671 - DNA, 20 bp, Artificial sequence
  Synthetic oligonucleotide
ccctgctcccgaaccccaat

SEQ ID NO: 1672 - DNA, 20 bp, Artificial sequence
  Synthetic oligonucleotide
gtctcctcccctacccctgc

SEQ ID NO: 1673 - DNA, 20 bp, Artificial sequence
  Synthetic oligonucleotide
ctacacattctcacaaccca

SEQ ID NO: 1674 - DNA, 20 bp, Artificial sequence
  Synthetic oligonucleotide
agttggcctttgcagcccgg

SEQ ID NO: 1675 - DNA, 20 bp, Artificial sequence
  Synthetic oligonucleotide
ccaggatttgaatgggcgga

SEQ ID NO: 1676 - DNA, 20 bp, Artificial sequence
  Synthetic oligonucleotide
cgcttgtaaacccactcatg

SEQ ID NO: 1677 - DNA, 20 bp, Artificial sequence
  Synthetic oligonucleotide
tgagatttgtgcctgacggc

SEQ ID NO: 1678 - DNA, 20 bp, Artificial sequence
  Synthetic oligonucleotide
ccgttggtccagctgcctat

SEQ ID NO: 1679 - DNA, 20 bp, Artificial sequence
  Synthetic oligonucleotide
gctcaccagcaggaacccca

SEQ ID NO: 1680 - DNA, 20 bp, Artificial sequence
  Synthetic oligonucleotide
ctttgtacttatgctccttg

SEQ ID NO: 1681 - DNA, 20 bp, Artificial sequence
  Synthetic oligonucleotide
ccggtgacagtgagaacgac

SEQ ID NO: 1682 - DNA, 20 bp, Artificial sequence
  Synthetic oligonucleotide
tacatttgtggtacagctgc

SEQ ID NO: 1683 - DNA, 20 bp, Artificial sequence
  Synthetic oligonucleotide
cgctggtcctgatcaaagtt

SEQ ID NO: 1684 - DNA, 20 bp, Artificial sequence
  Synthetic oligonucleotide
tggtctttcactttcttggg

SEQ ID NO: 1685 - DNA, 20 bp, Artificial sequence
  Synthetic oligonucleotide
ccgcttggcatgttcacaca

SEQ ID NO: 1686 - DNA, 20 bp, Artificial sequence
  Synthetic oligonucleotide
gcacttctctttctggcagt

SEQ ID NO: 1687 - DNA, 20 bp, Artificial sequence
  Synthetic oligonucleotide
atctcattcttgtggaaaaa

SEQ ID NO: 1688 - DNA, 20 bp, Artificial sequence
  Synthetic oligonucleotide
actggcatctggccacagct

SEQ ID NO: 1689 - DNA, 20 bp, Artificial sequence
  Synthetic oligonucleotide
ggctggccagccgctggcag

SEQ ID NO: 1690 - DNA, 20 bp, Artificial sequence
  Synthetic oligonucleotide
gcgacccccatggaggcacg

SEQ ID NO: 1691 - DNA, 20 bp, Artificial sequence
  Synthetic oligonucleotide
accgggcagtggcacaggcg

SEQ ID NO: 1692 - DNA, 20 bp, Artificial sequence
  Synthetic oligonucleotide
agcccgcggccatcatagca

SEQ ID NO: 1693 - DNA, 20 bp, Artificial sequence
  Synthetic oligonucleotide
cccagttccgcgcttgctcg

SEQ ID NO: 1694 - DNA, 20 bp, Artificial sequence
  Synthetic oligonucleotide
agctcagccggtcgcggttc

SEQ ID NO: 1695 - DNA, 20 bp, Artificial sequence
  Synthetic oligonucleotide
tgagtgggacatgaagccta

SEQ ID NO: 1696 - DNA, 20 bp, Artificial sequence
  Synthetic oligonucleotide
cttcgccggcaaggctcccg

SEQ ID NO: 1697 - DNA, 20 bp, Artificial sequence
  Synthetic oligonucleotide
gctcagtgggccgttcctgg

SEQ ID NO: 1698 - DNA, 20 bp, Artificial sequence
  Synthetic oligonucleotide
catcgaagacagactcttgc

SEQ ID NO: 1699 - DNA, 20 bp, Artificial sequence
  Synthetic oligonucleotide
actgtggccccagtacagcg

SEQ ID NO: 1700 - DNA, 20 bp, Artificial sequence
  Synthetic oligonucleotide
gtgcgggccggtcctgcagg

SEQ ID NO: 1701 - DNA, 20 bp, Artificial sequence
  Synthetic oligonucleotide
cgtctggcacggctcacagc

SEQ ID NO: 1702 - DNA, 20 bp, Artificial sequence
  Synthetic oligonucleotide
cgcatcctcctgaaggcgca

SEQ ID NO: 1703 - DNA, 20 bp, Artificial sequence
  Synthetic oligonucleotide
gtctcggagggtcgcgcggc

SEQ ID NO: 1704 - DNA, 20 bp, Artificial sequence
  Synthetic oligonucleotide
ctccgccccctcgaactggt

SEQ ID NO: 1705 - DNA, 20 bp, Artificial sequence
  Synthetic oligonucleotide
agaggaacggtacctgcgcc

SEQ ID NO: 1706 - DNA, 20 bp, Artificial sequence
  Synthetic oligonucleotide
cgcatcggtgccgccctcga

SEQ ID NO: 1707 - DNA, 20 bp, Artificial sequence
  Synthetic oligonucleotide
gctgatgatgccttgcaggg

SEQ ID NO: 1708 - DNA, 20 bp, Artificial sequence
  Synthetic oligonucleotide
cttgttgcggtcaccacagc

SEQ ID NO: 1709 - DNA, 20 bp, Artificial sequence
  Synthetic oligonucleotide
tcccggatccaggccaggta

SEQ ID NO: 1710 - DNA, 20 bp, Artificial sequence
  Synthetic oligonucleotide
aggagggaaagatgagtccc

SEQ ID NO: 1711 - DNA, 20 bp, Artificial sequence
  Synthetic oligonucleotide
tccatgccccagccactctc

SEQ ID NO: 1712 - DNA, 20 bp, Artificial sequence
  Synthetic oligonucleotide
tcagcattttcaaagcactt

SEQ ID NO: 1713 - DNA, 20 bp, Artificial sequence
  Synthetic oligonucleotide
ggctcatggctgtgatagcg

SEQ ID NO: 1714 - DNA, 20 bp, Artificial sequence
  Synthetic oligonucleotide
ttgtctgtctcctctgcctg

SEQ ID NO: 1715 - DNA, 20 bp, Artificial sequence
  Synthetic oligonucleotide
gacccaaaccctttctacct

SEQ ID NO: 1716 - DNA, 20 bp, Artificial sequence
  Synthetic oligonucleotide
ggaactgactataagtcata

SEQ ID NO: 1717 - DNA, 20 bp, Artificial sequence
  Synthetic oligonucleotide
gcacacactgcaccatacac

SEQ ID NO: 1718 - DNA, 20 bp, Artificial sequence
  Synthetic oligonucleotide
ctcaaggatcacacagctca

SEQ ID NO: 1719 - DNA, 20 bp, Artificial sequence
  Synthetic oligonucleotide
gcatgaatgatgcccatgag

SEQ ID NO: 1720 - DNA, 20 bp, Artificial sequence
  Synthetic oligonucleotide
cataagtgataaagctgggc

SEQ ID NO: 1721 - DNA, 20 bp, Artificial sequence
  Synthetic oligonucleotide
ggtttcccttctcaacaacc

SEQ ID NO: 1722 - DNA, 20 bp, Artificial sequence
  Synthetic oligonucleotide
atggcaggtacccttcatct

SEQ ID NO: 1723 - DNA, 20 bp, Artificial sequence
  Synthetic oligonucleotide
gtaaggtccatctggttcac

SEQ ID NO: 1724 - DNA, 20 bp, Artificial sequence
  Synthetic oligonucleotide
gtaaggcaagagagaggaga

SEQ ID NO: 1725 - DNA, 20 bp, Artificial sequence
  Synthetic oligonucleotide
atggaaatggatctgagatg

SEQ ID NO: 1726 - DNA, 20 bp, Artificial sequence
  Synthetic oligonucleotide
aatgctgagcagtgtctggc

SEQ ID NO: 1727 - DNA, 20 bp, Artificial sequence
  Synthetic oligonucleotide
tgctagttcaatgttcactg

SEQ ID NO: 1728 - DNA, 20 bp, Artificial sequence
  Synthetic oligonucleotide
agcttagcattgatgaatca

SEQ ID NO: 1729 - DNA, 20 bp, Artificial sequence
  Synthetic oligonucleotide
aaatggcctctgagcctcct

SEQ ID NO: 1730 - DNA, 20 bp, Artificial sequence
  Synthetic oligonucleotide
attcccagttaaggttcaac

SEQ ID NO: 1731 - DNA, 20 bp, Artificial sequence
  Synthetic oligonucleotide
gagaatgtgcctacttgctg

SEQ ID NO: 1732 - DNA, 20 bp, Artificial sequence
  Synthetic oligonucleotide
tgttgaagtcactgttaacc

SEQ ID NO: 1733 - DNA, 20 bp, Artificial sequence
  Synthetic oligonucleotide
cctgactccacaacctgcta

SEQ ID NO: 1734 - DNA, 20 bp, Artificial sequence
  Synthetic oligonucleotide
cagaccctcaaaaaggtcgc

SEQ ID NO: 1735 - DNA, 20 bp, Artificial sequence
  Synthetic oligonucleotide
tgagaactgcagggacaaca

SEQ ID NO: 1736 - DNA, 20 bp, Artificial sequence
  Synthetic oligonucleotide
ctatcacagtcccctctctc

SEQ ID NO: 1737 - DNA, 20 bp, Artificial sequence
  Synthetic oligonucleotide
gaggagagagccccaggcca

SEQ ID NO: 1738 - DNA, 20 bp, Artificial sequence
  Synthetic oligonucleotide
gaccactccttcccagaact

SEQ ID NO: 1739 - DNA, 20 bp, Artificial sequence
  Synthetic oligonucleotide
gggagctgagtcacacagct

SEQ ID NO: 1740 - DNA, 20 bp, Artificial sequence
  Synthetic oligonucleotide
ttgcccctgtcccccagcac

SEQ ID NO: 1741 - DNA, 20 bp, Artificial sequence
  Synthetic oligonucleotide
tgctcaccctggctggccag

SEQ ID NO: 1742 - DNA, 20 bp, Artificial sequence
  Synthetic oligonucleotide
taaagacccccccagagagc

SEQ ID NO: 1743 - DNA, 20 bp, Artificial sequence
  Synthetic oligonucleotide
cgcactctccctcctccttc

SEQ ID NO: 1744 - DNA, 20 bp, Artificial sequence
  Synthetic oligonucleotide
tcctgtagccacacgacggg

SEQ ID NO: 1745 - DNA, 20 bp, Artificial sequence
  Synthetic oligonucleotide
ttcgccggcaaggctgtgga

SEQ ID NO: 1746 - DNA, 20 bp, Artificial sequence
  Synthetic oligonucleotide
gaagccccctgctcccgaac

SEQ ID NO: 1747 - DNA, 20 bp, Artificial sequence
  Synthetic oligonucleotide
tcaaaggtctcctcccctac

SEQ ID NO: 1748 - DNA, 20 bp, Artificial sequence
  Synthetic oligonucleotide
attcacctacacattctcac

SEQ ID NO: 1749 - DNA, 20 bp, Artificial sequence
  Synthetic oligonucleotide
cgtcctagttggcctttgca

SEQ ID NO: 1750 - DNA, 20 bp, Artificial sequence
  Synthetic oligonucleotide
agagaaaagccaggatttga

SEQ ID NO: 1751 - DNA, 20 bp, Artificial sequence
  Synthetic oligonucleotide
atggacaaagctgctccagg

SEQ ID NO: 1752 - DNA, 20 bp, Artificial sequence
  Synthetic oligonucleotide
tggacctgagatttgtgcct

SEQ ID NO: 1753 - DNA, 20 bp, Artificial sequence
  Synthetic oligonucleotide
ctcaccagcaggaaccccag

SEQ ID NO: 1754 - DNA, 20 bp, Artificial sequence
  Synthetic oligonucleotide
tttgtacttatgctccttgg

SEQ ID NO: 1755 - DNA, 20 bp, Artificial sequence
  Synthetic oligonucleotide
cggtgacagtgagaacgact

SEQ ID NO: 1756 - DNA, 20 bp, Artificial sequence
  Synthetic oligonucleotide
acatttgtggtacagctgcc

SEQ ID NO: 1757 - DNA, 20 bp, Artificial sequence
  Synthetic oligonucleotide
gctggtcctgatcaaagttg

SEQ ID NO: 1758 - DNA, 20 bp, Artificial sequence
  Synthetic oligonucleotide
ggtctttcactttcttgggc

SEQ ID NO: 1759 - DNA, 20 bp, Artificial sequence
  Synthetic oligonucleotide
cgcttggcatgttcacacag

SEQ ID NO: 1760 - DNA, 20 bp, Artificial sequence
  Synthetic oligonucleotide
cacttctctttctggcagtg

SEQ ID NO: 1761 - DNA, 20 bp, Artificial sequence
  Synthetic oligonucleotide
tctcattcttgtggaaaaac

SEQ ID NO: 1762 - DNA, 20 bp, Artificial sequence
  Synthetic oligonucleotide
ctggcatctggccacagctg

SEQ ID NO: 1763 - DNA, 20 bp, Artificial sequence
  Synthetic oligonucleotide
gctggccagccgctggcagt

SEQ ID NO: 1764 - DNA, 20 bp, Artificial sequence
  Synthetic oligonucleotide
gacccccatggaggcacggg

SEQ ID NO: 1765 - DNA, 20 bp, Artificial sequence
  Synthetic oligonucleotide
cgggcagtggcacaggcggt

SEQ ID NO: 1766 - DNA, 20 bp, Artificial sequence
  Synthetic oligonucleotide
gcccgcggccatcatagcag

SEQ ID NO: 1767 - DNA, 20 bp, Artificial sequence
  Synthetic oligonucleotide
cggctgacagggcgcacccg

SEQ ID NO: 1768 - DNA, 20 bp, Artificial sequence
  Synthetic oligonucleotide
ccagttccgcgcttgctcgg

SEQ ID NO: 1769 - DNA, 20 bp, Artificial sequence
  Synthetic oligonucleotide
gctcagccggtcgcggttca

SEQ ID NO: 1770 - DNA, 20 bp, Artificial sequence
  Synthetic oligonucleotide
gagtgggacatgaagcctag

SEQ ID NO: 1771 - DNA, 20 bp, Artificial sequence
  Synthetic oligonucleotide
ttcgccggcaaggctcccgg

SEQ ID NO: 1772 - DNA, 20 bp, Artificial sequence
  Synthetic oligonucleotide
tcagtgggccgttcctggtc

SEQ ID NO: 1773 - DNA, 20 bp, Artificial sequence
  Synthetic oligonucleotide
atcgaagacagactcttgcg

SEQ ID NO: 1774 - DNA, 20 bp, Artificial sequence
  Synthetic oligonucleotide
tgtggccccagtacagcgcg

SEQ ID NO: 1775 - DNA, 20 bp, Artificial sequence
  Synthetic oligonucleotide
gcgggccggtcctgcaggca

SEQ ID NO: 1776 - DNA, 20 bp, Artificial sequence
  Synthetic oligonucleotide
gtctggcacggctcacagct

SEQ ID NO: 1777 - DNA, 20 bp, Artificial sequence
  Synthetic oligonucleotide
gcatcctcctgaaggcgcaa

SEQ ID NO: 1778 - DNA, 20 bp, Artificial sequence
  Synthetic oligonucleotide
cgccgcttggcaggcacacc

SEQ ID NO: 1779 - DNA, 20 bp, Artificial sequence
  Synthetic oligonucleotide
tccgccccctcgaactggtg

SEQ ID NO: 1780 - DNA, 20 bp, Artificial sequence
  Synthetic oligonucleotide
aggaacggtacctgcgcctc

SEQ ID NO: 1781 - DNA, 20 bp, Artificial sequence
  Synthetic oligonucleotide
ctgatgatgccttgcagggt

SEQ ID NO: 1782 - DNA, 20 bp, Artificial sequence
  Synthetic oligonucleotide
tgttgcggtcaccacagccc

SEQ ID NO: 1783 - DNA, 20 bp, Artificial sequence
  Synthetic oligonucleotide
cccggatccaggccaggtag

SEQ ID NO: 1784 - DNA, 20 bp, Artificial sequence
  Synthetic oligonucleotide
ccatgccccagccactctct

SEQ ID NO: 1785 - DNA, 20 bp, Artificial sequence
  Synthetic oligonucleotide
ccatcctggcgcggagctgg

SEQ ID NO: 1786 - DNA, 20 bp, Artificial sequence
  Synthetic oligonucleotide
cagcattttcaaagcacttt

SEQ ID NO: 1787 - DNA, 20 bp, Artificial sequence
  Synthetic oligonucleotide
tcatggctgtgatagcgacc

SEQ ID NO: 1788 - DNA, 20 bp, Artificial sequence
  Synthetic oligonucleotide
tctgtctcctctgcctgggc

SEQ ID NO: 1789 - DNA, 20 bp, Artificial sequence
  Synthetic oligonucleotide
ccaaaccctttctacctccc

SEQ ID NO: 1790 - DNA, 20 bp, Artificial sequence
  Synthetic oligonucleotide
actgactataagtcatagcc

SEQ ID NO: 1791 - DNA, 20 bp, Artificial sequence
  Synthetic oligonucleotide
acactgcaccatacacatcc

SEQ ID NO: 1792 - DNA, 20 bp, Artificial sequence
  Synthetic oligonucleotide
aaggatcacacagctcacga

SEQ ID NO: 1793 - DNA, 20 bp, Artificial sequence
  Synthetic oligonucleotide
tgaatgatgcccatgagacg

SEQ ID NO: 1794 - DNA, 20 bp, Artificial sequence
  Synthetic oligonucleotide
aagtgataaagctgggcttc

SEQ ID NO: 1795 - DNA, 20 bp, Artificial sequence
  Synthetic oligonucleotide
ttcccttctcaacaacccta

SEQ ID NO: 1796 - DNA, 20 bp, Artificial sequence
  Synthetic oligonucleotide
gcaggtacccttcatctaaa

SEQ ID NO: 1797 - DNA, 20 bp, Artificial sequence
  Synthetic oligonucleotide
aggtccatctggttcacagg

SEQ ID NO: 1798 - DNA, 20 bp, Artificial sequence
  Synthetic oligonucleotide
aggcaagagagaggagaaac

SEQ ID NO: 1799 - DNA, 20 bp, Artificial sequence
  Synthetic oligonucleotide
gaaatggatctgagatggac

SEQ ID NO: 1800 - DNA, 20 bp, Artificial sequence
  Synthetic oligonucleotide
gctgagcagtgtctggcaca

SEQ ID NO: 1801 - DNA, 20 bp, Artificial sequence
  Synthetic oligonucleotide
tagttcaatgttcactgtga

SEQ ID NO: 1802 - DNA, 20 bp, Artificial sequence
  Synthetic oligonucleotide
ttagcattgatgaatcagca

SEQ ID NO: 1803 - DNA, 20 bp, Artificial sequence
  Synthetic oligonucleotide
tggcctctgagcctcctgct

SEQ ID NO: 1804 - DNA, 20 bp, Artificial sequence
  Synthetic oligonucleotide
cccagttaaggttcaacaag

SEQ ID NO: 1805 - DNA, 20 bp, Artificial sequence
  Synthetic oligonucleotide
aatgtgcctacttgctgaat

SEQ ID NO: 1806 - DNA, 20 bp, Artificial sequence
  Synthetic oligonucleotide
tgaagtcactgttaaccact

SEQ ID NO: 1807 - DNA, 20 bp, Artificial sequence
  Synthetic oligonucleotide
gactccacaacctgctagct

SEQ ID NO: 1808 - DNA, 20 bp, Artificial sequence
  Synthetic oligonucleotide
accctcaaaaaggtcgctgt

SEQ ID NO: 1809 - DNA, 20 bp, Artificial sequence
  Synthetic oligonucleotide
gaactgcagggacaacacac

SEQ ID NO: 1810 - DNA, 20 bp, Artificial sequence
  Synthetic oligonucleotide
tcacagtcccctctctccaa

SEQ ID NO: 1811 - DNA, 20 bp, Artificial sequence
  Synthetic oligonucleotide
gagagagccccaggccaccc

SEQ ID NO: 1812 - DNA, 20 bp, Artificial sequence
  Synthetic oligonucleotide
cactccttcccagaactctc

SEQ ID NO: 1813 - DNA, 20 bp, Artificial sequence
  Synthetic oligonucleotide
agctgagtcacacagctggg

SEQ ID NO: 1814 - DNA, 20 bp, Artificial sequence
  Synthetic oligonucleotide
ccccagcaccccgcccaggt

SEQ ID NO: 1815 - DNA, 20 bp, Artificial sequence
  Synthetic oligonucleotide
tcaccctggctggccagccg

SEQ ID NO: 1816 - DNA, 20 bp, Artificial sequence
  Synthetic oligonucleotide
agacccccccagagagctct

SEQ ID NO: 1817 - DNA, 20 bp, Artificial sequence
  Synthetic oligonucleotide
actctccctcctccttcctg

SEQ ID NO: 1818 - DNA, 20 bp, Artificial sequence
  Synthetic oligonucleotide
gcgccgggagcccggagccc

SEQ ID NO: 1819 - DNA, 20 bp, Artificial sequence
  Synthetic oligonucleotide
ggcaaggctgtggaggagca

SEQ ID NO: 1820 - DNA, 20 bp, Artificial sequence
  Synthetic oligonucleotide
gccccctgctcccgaacccc

SEQ ID NO: 1821 - DNA, 20 bp, Artificial sequence
  Synthetic oligonucleotide
aaggtctcctcccctacccc

SEQ ID NO: 1822 - DNA, 20 bp, Artificial sequence
  Synthetic oligonucleotide
cacctacacattctcacaac

SEQ ID NO: 1823 - DNA, 20 bp, Artificial sequence
  Synthetic oligonucleotide
cctagttggcctttgcagcc

SEQ ID NO: 1824 - DNA, 20 bp, Artificial sequence
  Synthetic oligonucleotide
aagccaggatttgaatgggc

SEQ ID NO: 1825 - DNA, 20 bp, Artificial sequence
  Synthetic oligonucleotide
gacaaagctgctccaggcgc

SEQ ID NO: 1826 - DNA, 20 bp, Artificial sequence
  Synthetic oligonucleotide
gcatcggtgccgccctcgag

SEQ ID NO: 1827 - DNA, 20 bp, Artificial sequence
  Synthetic oligonucleotide
acctgagatttgtgcctgac

SEQ ID NO: 1828 - DNA, 20 bp, Artificial sequence
  Synthetic oligonucleotide
tccgttggtccagctgccta

SEQ ID NO: 1829 - DNA, 20 bp, Artificial sequence
  Synthetic oligonucleotide
agctcaccagcaggaacccc

SEQ ID NO: 1830 - DNA, 20 bp, Artificial sequence
  Synthetic oligonucleotide
gctttgtacttatgctcctt

SEQ ID NO: 1831 - DNA, 20 bp, Artificial sequence
  Synthetic oligonucleotide
cccggtgacagtgagaacga

SEQ ID NO: 1832 - DNA, 20 bp, Artificial sequence
  Synthetic oligonucleotide
tcgctggtcctgatcaaagt

SEQ ID NO: 1833 - DNA, 20 bp, Artificial sequence
  Synthetic oligonucleotide
agtggtctttcactttcttg

SEQ ID NO: 1834 - DNA, 20 bp, Artificial sequence
  Synthetic oligonucleotide
gccgcttggcatgttcacac

SEQ ID NO: 1835 - DNA, 20 bp, Artificial sequence
  Synthetic oligonucleotide
agcacttctctttctggcag

SEQ ID NO: 1836 - DNA, 20 bp, Artificial sequence
  Synthetic oligonucleotide
atatctcattcttgtggaaa

SEQ ID NO: 1837 - DNA, 20 bp, Artificial sequence
  Synthetic oligonucleotide
cccttgcactggcatctggc

SEQ ID NO: 1838 - DNA, 20 bp, Artificial sequence
  Synthetic oligonucleotide
tggctggccagccgctggca

SEQ ID NO: 1839 - DNA, 20 bp, Artificial sequence
  Synthetic oligonucleotide
agcgacccccatggaggcac

SEQ ID NO: 1840 - DNA, 20 bp, Artificial sequence
  Synthetic oligonucleotide
ccaccgggcagtggcacagg

SEQ ID NO: 1841 - DNA, 20 bp, Artificial sequence
  Synthetic oligonucleotide
gagcccgcggccatcatagc

SEQ ID NO: 1842 - DNA, 20 bp, Artificial sequence
  Synthetic oligonucleotide
cacggctgacagggcgcacc

SEQ ID NO: 1843 - DNA, 20 bp, Artificial sequence
  Synthetic oligonucleotide
ccagctcagccggtcgcggt

SEQ ID NO: 1844 - DNA, 20 bp, Artificial sequence
  Synthetic oligonucleotide
atgagtgggacatgaagcct

SEQ ID NO: 1845 - DNA, 20 bp, Artificial sequence
  Synthetic oligonucleotide
gcttcgccggcaaggctccc

SEQ ID NO: 1846 - DNA, 20 bp, Artificial sequence
  Synthetic oligonucleotide
cagctcagtgggccgttcct

SEQ ID NO: 1847 - DNA, 20 bp, Artificial sequence
  Synthetic oligonucleotide
tcatcgaagacagactcttg

SEQ ID NO: 1848 - DNA, 20 bp, Artificial sequence
  Synthetic oligonucleotide
aactgtggccccagtacagc

SEQ ID NO: 1849 - DNA, 20 bp, Artificial sequence
  Synthetic oligonucleotide
ggtgcgggccggtcctgcag

SEQ ID NO: 1850 - DNA, 20 bp, Artificial sequence
  Synthetic oligonucleotide
gtaggagcgcacggccaacg

SEQ ID NO: 1851 - DNA, 20 bp, Artificial sequence
  Synthetic oligonucleotide
tccgcatcctcctgaaggcg

SEQ ID NO: 1852 - DNA, 20 bp, Artificial sequence
  Synthetic oligonucleotide
ggtctcggagggtcgcgcgg

SEQ ID NO: 1853 - DNA, 20 bp, Artificial sequence
  Synthetic oligonucleotide
cctccgccccctcgaactgg

SEQ ID NO: 1854 - DNA, 20 bp, Artificial sequence
  Synthetic oligonucleotide
gagaggaacggtacctgcgc

SEQ ID NO: 1855 - DNA, 20 bp, Artificial sequence
  Synthetic oligonucleotide
gcacgcatcggtgccgccct

SEQ ID NO: 1856 - DNA, 20 bp, Artificial sequence
  Synthetic oligonucleotide
agctgatgatgccttgcagg

SEQ ID NO: 1857 - DNA, 20 bp, Artificial sequence
  Synthetic oligonucleotide
gcttgttgcggtcaccacag

SEQ ID NO: 1858 - DNA, 20 bp, Artificial sequence
  Synthetic oligonucleotide
ctcccggatccaggccaggt

SEQ ID NO: 1859 - DNA, 20 bp, Artificial sequence
  Synthetic oligonucleotide
aaggagggaaagatgagtcc

SEQ ID NO: 1860 - DNA, 20 bp, Artificial sequence
  Synthetic oligonucleotide
ttccatgccccagccactct

SEQ ID NO: 1861 - DNA, 20 bp, Artificial sequence
  Synthetic oligonucleotide
cgccatcctggcgcggagct

SEQ ID NO: 1862 - DNA, 20 bp, Artificial sequence
  Synthetic oligonucleotide
catggctcatggctgtgata

SEQ ID NO: 1863 - DNA, 20 bp, Artificial sequence
  Synthetic oligonucleotide
tggttgtctgtctcctctgc

SEQ ID NO: 1864 - DNA, 20 bp, Artificial sequence
  Synthetic oligonucleotide
caagacccaaaccctttcta

SEQ ID NO: 1865 - DNA, 20 bp, Artificial sequence
  Synthetic oligonucleotide
cagggaactgactataagtc

SEQ ID NO: 1866 - DNA, 20 bp, Artificial sequence
  Synthetic oligonucleotide
actgcacacactgcaccata

SEQ ID NO: 1867 - DNA, 20 bp, Artificial sequence
  Synthetic oligonucleotide
gccctcaaggatcacacagc

SEQ ID NO: 1868 - DNA, 20 bp, Artificial sequence
  Synthetic oligonucleotide
gtggcatgaatgatgcccat

SEQ ID NO: 1869 - DNA, 20 bp, Artificial sequence
  Synthetic oligonucleotide
gctcataagtgataaagctg

SEQ ID NO: 1870 - DNA, 20 bp, Artificial sequence
  Synthetic oligonucleotide
cacatgggtttcccttctca

SEQ ID NO: 1871 - DNA, 20 bp, Artificial sequence
  Synthetic oligonucleotide
gaaatggcaggtacccttca

SEQ ID NO: 1872 - DNA, 20 bp, Artificial sequence
  Synthetic oligonucleotide
agggtaaggtccatctggtt

SEQ ID NO: 1873 - DNA, 20 bp, Artificial sequence
  Synthetic oligonucleotide
gtttgggtaaggcaagagag

SEQ ID NO: 1874 - DNA, 20 bp, Artificial sequence
  Synthetic oligonucleotide
taaatggaaatggatctgag

SEQ ID NO: 1875 - DNA, 20 bp, Artificial sequence
  Synthetic oligonucleotide
tgaaatgctgagcagtgtct

SEQ ID NO: 1876 - DNA, 20 bp, Artificial sequence
  Synthetic oligonucleotide
gtttgctagttcaatgttca

SEQ ID NO: 1877 - DNA, 20 bp, Artificial sequence
  Synthetic oligonucleotide
atcagcttagcattgatgaa

SEQ ID NO: 1878 - DNA, 20 bp, Artificial sequence
  Synthetic oligonucleotide
tggaaatggcctctgagcct

SEQ ID NO: 1879 - DNA, 20 bp, Artificial sequence
  Synthetic oligonucleotide
cacattcccagttaaggttc

SEQ ID NO: 1880 - DNA, 20 bp, Artificial sequence
  Synthetic oligonucleotide
attgagaatgtgcctacttg

SEQ ID NO: 1881 - DNA, 20 bp, Artificial sequence
  Synthetic oligonucleotide
gaatgttgaagtcactgtta

SEQ ID NO: 1882 - DNA, 20 bp, Artificial sequence
  Synthetic oligonucleotide
actcctgactccacaacctg

SEQ ID NO: 1883 - DNA, 20 bp, Artificial sequence
  Synthetic oligonucleotide
ggacagaccctcaaaaaggt

SEQ ID NO: 1884 - DNA, 20 bp, Artificial sequence
  Synthetic oligonucleotide
cagtgagaactgcagggaca

SEQ ID NO: 1885 - DNA, 20 bp, Artificial sequence
  Synthetic oligonucleotide
gccctatcacagtcccctct

SEQ ID NO: 1886 - DNA, 20 bp, Artificial sequence
  Synthetic oligonucleotide
cgggaggagagagccccagg

SEQ ID NO: 1887 - DNA, 20 bp, Artificial sequence
  Synthetic oligonucleotide
tgggaccactccttcccaga

SEQ ID NO: 1888 - DNA, 20 bp, Artificial sequence
  Synthetic oligonucleotide
gcagggagctgagtcacaca

SEQ ID NO: 1889 - DNA, 20 bp, Artificial sequence
  Synthetic oligonucleotide
gggttgcccctgtcccccag

SEQ ID NO: 1890 - DNA, 20 bp, Artificial sequence
  Synthetic oligonucleotide
atctgctcaccctggctggc

SEQ ID NO: 1891 - DNA, 20 bp, Artificial sequence
  Synthetic oligonucleotide
gcctaaagacccccccagag

SEQ ID NO: 1892 - DNA, 20 bp, Artificial sequence
  Synthetic oligonucleotide
gctttccgcactctccctcc

SEQ ID NO: 1893 - DNA, 20 bp, Artificial sequence
  Synthetic oligonucleotide
ggttcctgtagccacacgac

SEQ ID NO: 1894 - DNA, 20 bp, Artificial sequence
  Synthetic oligonucleotide
cgcttcgccggcaaggctgt

SEQ ID NO: 1895 - DNA, 20 bp, Artificial sequence
  Synthetic oligonucleotide
ctcagacctggccacaagcg

SEQ ID NO: 1896 - DNA, 20 bp, Artificial sequence
  Synthetic oligonucleotide
tgatcaaaggtctcctcccc

SEQ ID NO: 1897 - DNA, 20 bp, Artificial sequence
  Synthetic oligonucleotide
gggattcacctacacattct

SEQ ID NO: 1898 - DNA, 20 bp, Artificial sequence
  Synthetic oligonucleotide
acactagcccggagcgcggg

SEQ ID NO: 1899 - DNA, 20 bp, Artificial sequence
  Synthetic oligonucleotide
tccagagaaaagccaggatt

SEQ ID NO: 1900 - DNA, 20 bp, Artificial sequence
  Synthetic oligonucleotide
acgatggacaaagctgctcc

SEQ ID NO: 1901 - DNA, 20 bp, Artificial sequence
  Synthetic oligonucleotide
ctgtggacctgagatttgtg

SEQ ID NO: 1902 - DNA, 20 bp, Artificial sequence
  Synthetic oligonucleotide
cgtccgttggtccagctgcc

SEQ ID NO: 1903 - DNA, 20 bp, Artificial sequence
  Synthetic oligonucleotide
aagctcaccagcaggaaccc

SEQ ID NO: 1904 - DNA, 20 bp, Artificial sequence
  Synthetic oligonucleotide
agctttgtacttatgctcct

SEQ ID NO: 1905 - DNA, 20 bp, Artificial sequence
  Synthetic oligonucleotide
ccccggtgacagtgagaacg

SEQ ID NO: 1906 - DNA, 20 bp, Artificial sequence
  Synthetic oligonucleotide
atcgctggtcctgatcaaag

SEQ ID NO: 1907 - DNA, 20 bp, Artificial sequence
  Synthetic oligonucleotide
cagtggtctttcactttctt

SEQ ID NO: 1908 - DNA, 20 bp, Artificial sequence
  Synthetic oligonucleotide
ggccgcttggcatgttcaca

SEQ ID NO: 1909 - DNA, 20 bp, Artificial sequence
  Synthetic oligonucleotide
aaagcacttctctttctggc

SEQ ID NO: 1910 - DNA, 20 bp, Artificial sequence
  Synthetic oligonucleotide
catatctcattcttgtggaa

SEQ ID NO: 1911 - DNA, 20 bp, Artificial sequence
  Synthetic oligonucleotide
acccttgcactggcatctgg

SEQ ID NO: 1912 - DNA, 20 bp, Artificial sequence
  Synthetic oligonucleotide
ctggctggccagccgctggc

SEQ ID NO: 1913 - DNA, 20 bp, Artificial sequence
  Synthetic oligonucleotide
gcagcgacccccatggaggc

SEQ ID NO: 1914 - DNA, 20 bp, Artificial sequence
  Synthetic oligonucleotide
cccaccgggcagtggcacag

SEQ ID NO: 1915 - DNA, 20 bp, Artificial sequence
  Synthetic oligonucleotide
ctgagcccgcggccatcata

SEQ ID NO: 1916 - DNA, 20 bp, Artificial sequence
  Synthetic oligonucleotide
ccacggctgacagggcgcac

SEQ ID NO: 1917 - DNA, 20 bp, Artificial sequence
  Synthetic oligonucleotide
cccagtccccagttccgcgc

SEQ ID NO: 1918 - DNA, 20 bp, Artificial sequence
  Synthetic oligonucleotide
cccagctcagccggtcgcgg

SEQ ID NO: 1919 - DNA, 20 bp, Artificial sequence
  Synthetic oligonucleotide
gcatgagtgggacatgaagc

SEQ ID NO: 1920 - DNA, 20 bp, Artificial sequence
  Synthetic oligonucleotide
cgcttcgccggcaaggctcc

SEQ ID NO: 1921 - DNA, 20 bp, Artificial sequence
  Synthetic oligonucleotide
gcagctcagtgggccgttcc

SEQ ID NO: 1922 - DNA, 20 bp, Artificial sequence
  Synthetic oligonucleotide
ggtcatcgaagacagactct

SEQ ID NO: 1923 - DNA, 20 bp, Artificial sequence
  Synthetic oligonucleotide
gaaactgtggccccagtaca

SEQ ID NO: 1924 - DNA, 20 bp, Artificial sequence
  Synthetic oligonucleotide
cgtcagatcctcgggtgcgg

SEQ ID NO: 1925 - DNA, 20 bp, Artificial sequence
  Synthetic oligonucleotide
ggtaggagcgcacggccaac

SEQ ID NO: 1926 - DNA, 20 bp, Artificial sequence
  Synthetic oligonucleotide
gtccgcatcctcctgaaggc

SEQ ID NO: 1927 - DNA, 20 bp, Artificial sequence
  Synthetic oligonucleotide
tggtctcggagggtcgcgcg

SEQ ID NO: 1928 - DNA, 20 bp, Artificial sequence
  Synthetic oligonucleotide
tcctccgccccctcgaactg

SEQ ID NO: 1929 - DNA, 20 bp, Artificial sequence
  Synthetic oligonucleotide
ggagaggaacggtacctgcg

SEQ ID NO: 1930 - DNA, 20 bp, Artificial sequence
  Synthetic oligonucleotide
tggcacgcatcggtgccgcc

SEQ ID NO: 1931 - DNA, 20 bp, Artificial sequence
  Synthetic oligonucleotide
cagctgatgatgccttgcag

SEQ ID NO: 1932 - DNA, 20 bp, Artificial sequence
  Synthetic oligonucleotide
ggcttgttgcggtcaccaca

SEQ ID NO: 1933 - DNA, 20 bp, Artificial sequence
  Synthetic oligonucleotide
gctcccggatccaggccagg

SEQ ID NO: 1934 - DNA, 20 bp, Artificial sequence
  Synthetic oligonucleotide
caaggagggaaagatgagtc

SEQ ID NO: 1935 - DNA, 20 bp, Artificial sequence
  Synthetic oligonucleotide
cttccatgccccagccactc

SEQ ID NO: 1936 - DNA, 20 bp, Artificial sequence
  Synthetic oligonucleotide
gcgccatcctggcgcggagc

SEQ ID NO: 1937 - DNA, 20 bp, Artificial sequence
  Synthetic oligonucleotide
ggccatggctcatggctgtg

SEQ ID NO: 1938 - DNA, 20 bp, Artificial sequence
  Synthetic oligonucleotide
gtctggttgtctgtctcctc

SEQ ID NO: 1939 - DNA, 20 bp, Artificial sequence
  Synthetic oligonucleotide
tcccaagacccaaacccttt

SEQ ID NO: 1940 - DNA, 20 bp, Artificial sequence
  Synthetic oligonucleotide
aggcagggaactgactataa

SEQ ID NO: 1941 - DNA, 20 bp, Artificial sequence
  Synthetic oligonucleotide
gagactgcacacactgcacc

SEQ ID NO: 1942 - DNA, 20 bp, Artificial sequence
  Synthetic oligonucleotide
cctgccctcaaggatcacac

SEQ ID NO: 1943 - DNA, 20 bp, Artificial sequence
  Synthetic oligonucleotide
tgtgtggcatgaatgatgcc

SEQ ID NO: 1944 - DNA, 20 bp, Artificial sequence
  Synthetic oligonucleotide
ccagctcataagtgataaag

SEQ ID NO: 1945 - DNA, 20 bp, Artificial sequence
  Synthetic oligonucleotide
cctcacatgggtttcccttc

SEQ ID NO: 1946 - DNA, 20 bp, Artificial sequence
  Synthetic oligonucleotide
tggcagagcttgaggaaggg

SEQ ID NO: 1947 - DNA, 20 bp, Artificial sequence
  Synthetic oligonucleotide
accagggtaaggtccatctg

SEQ ID NO: 1948 - DNA, 20 bp, Artificial sequence
  Synthetic oligonucleotide
caagtttgggtaaggcaaga

SEQ ID NO: 1949 - DNA, 20 bp, Artificial sequence
  Synthetic oligonucleotide
cagtaaatggaaatggatct

SEQ ID NO: 1950 - DNA, 20 bp, Artificial sequence
  Synthetic oligonucleotide
ccatgaaatgctgagcagtg

SEQ ID NO: 1951 - DNA, 20 bp, Artificial sequence
  Synthetic oligonucleotide
actgtttgctagttcaatgt

SEQ ID NO: 1952 - DNA, 20 bp, Artificial sequence
  Synthetic oligonucleotide
gccatcagcttagcattgat

SEQ ID NO: 1953 - DNA, 20 bp, Artificial sequence
  Synthetic oligonucleotide
ttttggaaatggcctctgag

SEQ ID NO: 1954 - DNA, 20 bp, Artificial sequence
  Synthetic oligonucleotide
ttgcacattcccagttaagg

SEQ ID NO: 1955 - DNA, 20 bp, Artificial sequence
  Synthetic oligonucleotide
tacattgagaatgtgcctac

SEQ ID NO: 1956 - DNA, 20 bp, Artificial sequence
  Synthetic oligonucleotide
gttgaatgttgaagtcactg

SEQ ID NO: 1957 - DNA, 20 bp, Artificial sequence
  Synthetic oligonucleotide
tagactcctgactccacaac

SEQ ID NO: 1958 - DNA, 20 bp, Artificial sequence
  Synthetic oligonucleotide
aaaggacagaccctcaaaaa

SEQ ID NO: 1959 - DNA, 20 bp, Artificial sequence
  Synthetic oligonucleotide
tgacagtgagaactgcaggg

SEQ ID NO: 1960 - DNA, 20 bp, Artificial sequence
  Synthetic oligonucleotide
cctgccctatcacagtcccc

SEQ ID NO: 1961 - DNA, 20 bp, Artificial sequence
  Synthetic oligonucleotide
aggcgggaggagagagcccc

SEQ ID NO: 1962 - DNA, 20 bp, Artificial sequence
  Synthetic oligonucleotide
aaatgggaccactccttccc

SEQ ID NO: 1963 - DNA, 20 bp, Artificial sequence
  Synthetic oligonucleotide
agagcagggagctgagtcac

SEQ ID NO: 1964 - DNA, 20 bp, Artificial sequence
  Synthetic oligonucleotide
ccagggttgcccctgtcccc

SEQ ID NO: 1965 - DNA, 20 bp, Artificial sequence
  Synthetic oligonucleotide
accatctgctcaccctggct

SEQ ID NO: 1966 - DNA, 20 bp, Artificial sequence
  Synthetic oligonucleotide
tgggcctaaagaccccccca

SEQ ID NO: 1967 - DNA, 20 bp, Artificial sequence
  Synthetic oligonucleotide
tctgctttccgcactctccc

SEQ ID NO: 1968 - DNA, 20 bp, Artificial sequence
  Synthetic oligonucleotide
ccgggttcctgtagccacac

SEQ ID NO: 1969 - DNA, 20 bp, Artificial sequence
  Synthetic oligonucleotide
cgccggtcctgcaggcagtg

SEQ ID NO: 1970 - DNA, 20 bp, Artificial sequence
  Synthetic oligonucleotide
gctctcagacctggccacaa

SEQ ID NO: 1971 - DNA, 20 bp, Artificial sequence
  Synthetic oligonucleotide
cagtgatcaaaggtctcctc

SEQ ID NO: 1972 - DNA, 20 bp, Artificial sequence
  Synthetic oligonucleotide
cctgggattcacctacacat

SEQ ID NO: 1973 - DNA, 20 bp, Artificial sequence
  Synthetic oligonucleotide
cccacactagcccggagcgc

SEQ ID NO: 1974 - DNA, 20 bp, Artificial sequence
  Synthetic oligonucleotide
aggtccagagaaaagccagg

SEQ ID NO: 1975 - DNA, 20 bp, Artificial sequence
  Synthetic oligonucleotide
cggacgatggacaaagctgc

SEQ ID NO: 1976 - DNA, 20 bp, Artificial sequence
  Synthetic oligonucleotide
gcgctgtggacctgagattt

SEQ ID NO: 1977 - DNA, 20 bp, Artificial sequence
  Synthetic oligonucleotide
caagctcaccagcaggaacc

SEQ ID NO: 1978 - DNA, 20 bp, Artificial sequence
  Synthetic oligonucleotide
cagctttgtacttatgctcc

SEQ ID NO: 1979 - DNA, 20 bp, Artificial sequence
  Synthetic oligonucleotide
tgggtacatttgtggtacag

SEQ ID NO: 1980 - DNA, 20 bp, Artificial sequence
  Synthetic oligonucleotide
catcgctggtcctgatcaaa

SEQ ID NO: 1981 - DNA, 20 bp, Artificial sequence
  Synthetic oligonucleotide
gcagtggtctttcactttct

SEQ ID NO: 1982 - DNA, 20 bp, Artificial sequence
  Synthetic oligonucleotide
gggccgcttggcatgttcac

SEQ ID NO: 1983 - DNA, 20 bp, Artificial sequence
  Synthetic oligonucleotide
caaagcacttctctttctgg

SEQ ID NO: 1984 - DNA, 20 bp, Artificial sequence
  Synthetic oligonucleotide
accatatctcattcttgtgg

SEQ ID NO: 1985 - DNA, 20 bp, Artificial sequence
  Synthetic oligonucleotide
gacccttgcactggcatctg

SEQ ID NO: 1986 - DNA, 20 bp, Artificial sequence
  Synthetic oligonucleotide
cctggctggccagccgctgg

SEQ ID NO: 1987 - DNA, 20 bp, Artificial sequence
  Synthetic oligonucleotide
ggcagcgacccccatggagg

SEQ ID NO: 1988 - DNA, 20 bp, Artificial sequence
  Synthetic oligonucleotide
agcccaccgggcagtggcac

SEQ ID NO: 1989 - DNA, 20 bp, Artificial sequence
  Synthetic oligonucleotide
gctgagcccgcggccatcat

SEQ ID NO: 1990 - DNA, 20 bp, Artificial sequence
  Synthetic oligonucleotide
cccacggctgacagggcgca

SEQ ID NO: 1991 - DNA, 20 bp, Artificial sequence
  Synthetic oligonucleotide
gcccagtccccagttccgcg

SEQ ID NO: 1992 - DNA, 20 bp, Artificial sequence
  Synthetic oligonucleotide
tcccagctcagccggtcgcg

SEQ ID NO: 1993 - DNA, 20 bp, Artificial sequence
  Synthetic oligonucleotide
ggcatgagtgggacatgaag

SEQ ID NO: 1994 - DNA, 20 bp, Artificial sequence
  Synthetic oligonucleotide
ccgcttcgccggcaaggctc

SEQ ID NO: 1995 - DNA, 20 bp, Artificial sequence
  Synthetic oligonucleotide
cgcagctcagtgggccgttc

SEQ ID NO: 1996 - DNA, 20 bp, Artificial sequence
  Synthetic oligonucleotide
gggtcatcgaagacagactc

SEQ ID NO: 1997 - DNA, 20 bp, Artificial sequence
  Synthetic oligonucleotide
agaaactgtggccccagtac

SEQ ID NO: 1998 - DNA, 20 bp, Artificial sequence
  Synthetic oligonucleotide
ccgtcagatcctcgggtgcg

SEQ ID NO: 1999 - DNA, 20 bp, Artificial sequence
  Synthetic oligonucleotide
cggtaggagcgcacggccaa

SEQ ID NO: 2000 - DNA, 20 bp, Artificial sequence
  Synthetic oligonucleotide
ccgtccgcatcctcctgaag

SEQ ID NO: 2001 - DNA, 20 bp, Artificial sequence
  Synthetic oligonucleotide
gtggtctcggagggtcgcgc

SEQ ID NO: 2002 - DNA, 20 bp, Artificial sequence
  Synthetic oligonucleotide
ttcctccgccccctcgaact

SEQ ID NO: 2003 - DNA, 20 bp, Artificial sequence
  Synthetic oligonucleotide
gggagaggaacggtacctgc

SEQ ID NO: 2004 - DNA, 20 bp, Artificial sequence
  Synthetic oligonucleotide
ctggcacgcatcggtgccgc

SEQ ID NO: 2005 - DNA, 20 bp, Artificial sequence
  Synthetic oligonucleotide
ccagctgatgatgccttgca

SEQ ID NO: 2006 - DNA, 20 bp, Artificial sequence
  Synthetic oligonucleotide
tggcttgttgcggtcaccac

SEQ ID NO: 2007 - DNA, 20 bp, Artificial sequence
  Synthetic oligonucleotide
tgctcccggatccaggccag

SEQ ID NO: 2008 - DNA, 20 bp, Artificial sequence
  Synthetic oligonucleotide
ccaaggagggaaagatgagt

SEQ ID NO: 2009 - DNA, 20 bp, Artificial sequence
  Synthetic oligonucleotide
ccttccatgccccagccact

SEQ ID NO: 2010 - DNA, 20 bp, Artificial sequence
  Synthetic oligonucleotide
ctgcgccatcctggcgcgga

SEQ ID NO: 2011 - DNA, 20 bp, Artificial sequence
  Synthetic oligonucleotide
agaggccatggctcatggct

SEQ ID NO: 2012 - DNA, 20 bp, Artificial sequence
  Synthetic oligonucleotide
ccagtctggttgtctgtctc

SEQ ID NO: 2013 - DNA, 20 bp, Artificial sequence
  Synthetic oligonucleotide
tcttcccaagacccaaaccc

SEQ ID NO: 2014 - DNA, 20 bp, Artificial sequence
  Synthetic oligonucleotide
agaaggcagggaactgacta

SEQ ID NO: 2015 - DNA, 20 bp, Artificial sequence
  Synthetic oligonucleotide
cctgagactgcacacactgc

SEQ ID NO: 2016 - DNA, 20 bp, Artificial sequence
  Synthetic oligonucleotide
taccctgccctcaaggatca

SEQ ID NO: 2017 - DNA, 20 bp, Artificial sequence
  Synthetic oligonucleotide
ctctgtgtggcatgaatgat

SEQ ID NO: 2018 - DNA, 20 bp, Artificial sequence
  Synthetic oligonucleotide
cacccagctcataagtgata

SEQ ID NO: 2019 - DNA, 20 bp, Artificial sequence
  Synthetic oligonucleotide
atacctcacatgggtttccc

SEQ ID NO: 2020 - DNA, 20 bp, Artificial sequence
  Synthetic oligonucleotide
ctatggcagagcttgaggaa

SEQ ID NO: 2021 - DNA, 20 bp, Artificial sequence
  Synthetic oligonucleotide
cccaccagggtaaggtccat

SEQ ID NO: 2022 - DNA, 20 bp, Artificial sequence
  Synthetic oligonucleotide
caccaagtttgggtaaggca

SEQ ID NO: 2023 - DNA, 20 bp, Artificial sequence
  Synthetic oligonucleotide
ggacagtaaatggaaatgga

SEQ ID NO: 2024 - DNA, 20 bp, Artificial sequence
  Synthetic oligonucleotide
gagataatgccatgaaatgc

SEQ ID NO: 2025 - DNA, 20 bp, Artificial sequence
  Synthetic oligonucleotide
aatactgtttgctagttcaa

SEQ ID NO: 2026 - DNA, 20 bp, Artificial sequence
  Synthetic oligonucleotide
agtgccatcagcttagcatt

SEQ ID NO: 2027 - DNA, 20 bp, Artificial sequence
  Synthetic oligonucleotide
ggcttttggaaatggcctct

SEQ ID NO: 2028 - DNA, 20 bp, Artificial sequence
  Synthetic oligonucleotide
aatttgcacattcccagtta

SEQ ID NO: 2029 - DNA, 20 bp, Artificial sequence
  Synthetic oligonucleotide
ttctacattgagaatgtgcc

SEQ ID NO: 2030 - DNA, 20 bp, Artificial sequence
  Synthetic oligonucleotide
cttgttgaatgttgaagtca

SEQ ID NO: 2031 - DNA, 20 bp, Artificial sequence
  Synthetic oligonucleotide
gagtagactcctgactccac

SEQ ID NO: 2032 - DNA, 20 bp, Artificial sequence
  Synthetic oligonucleotide
ggaaaaggacagaccctcaa

SEQ ID NO: 2033 - DNA, 20 bp, Artificial sequence
  Synthetic oligonucleotide
cggtgacagtgagaactgca

SEQ ID NO: 2034 - DNA, 20 bp, Artificial sequence
  Synthetic oligonucleotide
caccctgccctatcacagtc

SEQ ID NO: 2035 - DNA, 20 bp, Artificial sequence
  Synthetic oligonucleotide
atgaggcgggaggagagagc

SEQ ID NO: 2036 - DNA, 20 bp, Artificial sequence
  Synthetic oligonucleotide
gcaaaatgggaccactcctt

SEQ ID NO: 2037 - DNA, 20 bp, Artificial sequence
  Synthetic oligonucleotide
ggaagagcagggagctgagt

SEQ ID NO: 2038 - DNA, 20 bp, Artificial sequence
  Synthetic oligonucleotide
ggcccagggttgcccctgtc

SEQ ID NO: 2039 - DNA, 20 bp, Artificial sequence
  Synthetic oligonucleotide
ccaaccatctgctcaccctg

SEQ ID NO: 2040 - DNA, 20 bp, Artificial sequence
  Synthetic oligonucleotide
ccctgggcctaaagaccccc

SEQ ID NO: 2041 - DNA, 20 bp, Artificial sequence
  Synthetic oligonucleotide
tcatctgctttccgcactct

SEQ ID NO: 2042 - DNA, 20 bp, Artificial sequence
  Synthetic oligonucleotide
tgtccgggttcctgtagcca

SEQ ID NO: 2043 - DNA, 20 bp, Artificial sequence
  Synthetic oligonucleotide
actcgccggtcctgcaggca

SEQ ID NO: 2044 - DNA, 20 bp, Artificial sequence
  Synthetic oligonucleotide
gcccccacgcacccaggtcg

SEQ ID NO: 2045 - DNA, 20 bp, Artificial sequence
  Synthetic oligonucleotide
acccagtgatcaaaggtctc

SEQ ID NO: 2046 - DNA, 20 bp, Artificial sequence
  Synthetic oligonucleotide
ctacctgggattcacctaca

SEQ ID NO: 2047 - DNA, 20 bp, Artificial sequence
  Synthetic oligonucleotide
gctcccacactagcccggag

SEQ ID NO: 2048 - DNA, 20 bp, Artificial sequence
  Synthetic oligonucleotide
ctgaggtccagagaaaagcc

SEQ ID NO: 2049 - DNA, 20 bp, Artificial sequence
  Synthetic oligonucleotide
gcccggacgatggacaaagc

SEQ ID NO: 2050 - DNA, 20 bp, Artificial sequence
  Synthetic oligonucleotide
ggaaacacgcagctcagcgc

SEQ ID NO: 2051 - DNA, 20 bp, Artificial sequence
  Synthetic oligonucleotide
atccgtccgttggtccagct

SEQ ID NO: 2052 - DNA, 20 bp, Artificial sequence
  Synthetic oligonucleotide
ccaagctcaccagcaggaac

SEQ ID NO: 2053 - DNA, 20 bp, Artificial sequence
  Synthetic oligonucleotide
tcagctttgtacttatgctc

SEQ ID NO: 2054 - DNA, 20 bp, Artificial sequence
  Synthetic oligonucleotide
ctccccggtgacagtgagaa

SEQ ID NO: 2055 - DNA, 20 bp, Artificial sequence
  Synthetic oligonucleotide
tgtgggtacatttgtggtac

SEQ ID NO: 2056 - DNA, 20 bp, Artificial sequence
  Synthetic oligonucleotide
cccatcgctggtcctgatca

SEQ ID NO: 2057 - DNA, 20 bp, Artificial sequence
  Synthetic oligonucleotide
ctgcagtggtctttcacttt

SEQ ID NO: 2058 - DNA, 20 bp, Artificial sequence
  Synthetic oligonucleotide
gttgtggacagagacagtgg

SEQ ID NO: 2059 - DNA, 20 bp, Artificial sequence
  Synthetic oligonucleotide
tcaaagcacttctctttctg

SEQ ID NO: 2060 - DNA, 20 bp, Artificial sequence
  Synthetic oligonucleotide
tataccatatctcattcttg

SEQ ID NO: 2061 - DNA, 20 bp, Artificial sequence
  Synthetic oligonucleotide
ggacccttgcactggcatct

SEQ ID NO: 2062 - DNA, 20 bp, Artificial sequence
  Synthetic oligonucleotide
gcctggctggccagccgctg

SEQ ID NO: 2063 - DNA, 20 bp, Artificial sequence
  Synthetic oligonucleotide
taggcagcgacccccatgga

SEQ ID NO: 2064 - DNA, 20 bp, Artificial sequence
  Synthetic oligonucleotide
tgtagcccaccgggcagtgg

SEQ ID NO: 2065 - DNA, 20 bp, Artificial sequence
  Synthetic oligonucleotide
agctgagcccgcggccatca

SEQ ID NO: 2066 - DNA, 20 bp, Artificial sequence
  Synthetic oligonucleotide
ggcccacggctgacagggcg

SEQ ID NO: 2067 - DNA, 20 bp, Artificial sequence
  Synthetic oligonucleotide
ccgcccagtccccagttccg

SEQ ID NO: 2068 - DNA, 20 bp, Artificial sequence
  Synthetic oligonucleotide
ctcccagctcagccggtcgc

SEQ ID NO: 2069 - DNA, 20 bp, Artificial sequence
  Synthetic oligonucleotide
ggctgcgcgggcatgagtgg

SEQ ID NO: 2070 - DNA, 20 bp, Artificial sequence
  Synthetic oligonucleotide
cccgcttcgccggcaaggct

SEQ ID NO: 2071 - DNA, 20 bp, Artificial sequence
  Synthetic oligonucleotide
ccgcagctcagtgggccgtt

SEQ ID NO: 2072 - DNA, 20 bp, Artificial sequence
  Synthetic oligonucleotide
gcgggtcatcgaagacagac

SEQ ID NO: 2073 - DNA, 20 bp, Artificial sequence
  Synthetic oligonucleotide
cagaaactgtggccccagta

SEQ ID NO: 2074 - DNA, 20 bp, Artificial sequence
  Synthetic oligonucleotide
caccgtcagatcctcgggtg

SEQ ID NO: 2075 - DNA, 20 bp, Artificial sequence
  Synthetic oligonucleotide
agcggtaggagcgcacggcc

SEQ ID NO: 2076 - DNA, 20 bp, Artificial sequence
  Synthetic oligonucleotide
gccgtccgcatcctcctgaa

SEQ ID NO: 2077 - DNA, 20 bp, Artificial sequence
  Synthetic oligonucleotide
cgtggtctcggagggtcgcg

SEQ ID NO: 2078 - DNA, 20 bp, Artificial sequence
  Synthetic oligonucleotide
attcctccgccccctcgaac

SEQ ID NO: 2079 - DNA, 20 bp, Artificial sequence
  Synthetic oligonucleotide
agggagaggaacggtacctg

SEQ ID NO: 2080 - DNA, 20 bp, Artificial sequence
  Synthetic oligonucleotide
ccctggcacgcatcggtgcc

SEQ ID NO: 2081 - DNA, 20 bp, Artificial sequence
  Synthetic oligonucleotide
cccagctgatgatgccttgc

SEQ ID NO: 2082 - DNA, 20 bp, Artificial sequence
  Synthetic oligonucleotide
ctggcttgttgcggtcacca

SEQ ID NO: 2083 - DNA, 20 bp, Artificial sequence
  Synthetic oligonucleotide
gtgctcccggatccaggcca

SEQ ID NO: 2084 - DNA, 20 bp, Artificial sequence
  Synthetic oligonucleotide
accaaggagggaaagatgag

SEQ ID NO: 2085 - DNA, 20 bp, Artificial sequence
  Synthetic oligonucleotide
gccttccatgccccagccac

SEQ ID NO: 2086 - DNA, 20 bp, Artificial sequence
  Synthetic oligonucleotide
cctgcgccatcctggcgcgg

SEQ ID NO: 2087 - DNA, 20 bp, Artificial sequence
  Synthetic oligonucleotide
agcagaggccatggctcatg

SEQ ID NO: 2088 - DNA, 20 bp, Artificial sequence
  Synthetic oligonucleotide
cacccagtctggttgtctgt

SEQ ID NO: 2089 - DNA, 20 bp, Artificial sequence
  Synthetic oligonucleotide
atttcttcccaagacccaaa

SEQ ID NO: 2090 - DNA, 20 bp, Artificial sequence
  Synthetic oligonucleotide
agaagaaggcagggaactga

SEQ ID NO: 2091 - DNA, 20 bp, Artificial sequence
  Synthetic oligonucleotide
gactgccctgagactgcaca

SEQ ID NO: 2092 - DNA, 20 bp, Artificial sequence
  Synthetic oligonucleotide
ccataccctgccctcaagga

SEQ ID NO: 2093 - DNA, 20 bp, Artificial sequence
  Synthetic oligonucleotide
ggcctctgtgtggcatgaat

SEQ ID NO: 2094 - DNA, 20 bp, Artificial sequence
  Synthetic oligonucleotide
gagtcacccagctcataagt

SEQ ID NO: 2095 - DNA, 20 bp, Artificial sequence
  Synthetic oligonucleotide
tgaatacctcacatgggttt

SEQ ID NO: 2096 - DNA, 20 bp, Artificial sequence
  Synthetic oligonucleotide
gagctatggcagagcttgag

SEQ ID NO: 2097 - DNA, 20 bp, Artificial sequence
  Synthetic oligonucleotide
aggcccaccagggtaaggtc

SEQ ID NO: 2098 - DNA, 20 bp, Artificial sequence
  Synthetic oligonucleotide
ggatagggcaccaagtttgg

SEQ ID NO: 2099 - DNA, 20 bp, Artificial sequence
  Synthetic oligonucleotide
ctaggacagtaaatggaaat

SEQ ID NO: 2100 - DNA, 20 bp, Artificial sequence
  Synthetic oligonucleotide
catgagataatgccatgaaa

SEQ ID NO: 2101 - DNA, 20 bp, Artificial sequence
  Synthetic oligonucleotide
cctaatactgtttgctagtt

SEQ ID NO: 2102 - DNA, 20 bp, Artificial sequence
  Synthetic oligonucleotide
tatagtgccatcagcttagc

SEQ ID NO: 2103 - DNA, 20 bp, Artificial sequence
  Synthetic oligonucleotide
tttggcttttggaaatggcc

SEQ ID NO: 2104 - DNA, 20 bp, Artificial sequence
  Synthetic oligonucleotide
aaaaatttgcacattcccag

SEQ ID NO: 2105 - DNA, 20 bp, Artificial sequence
  Synthetic oligonucleotide
tggttctacattgagaatgt

SEQ ID NO: 2106 - DNA, 20 bp, Artificial sequence
  Synthetic oligonucleotide
atacttgttgaatgttgaag

SEQ ID NO: 2107 - DNA, 20 bp, Artificial sequence
  Synthetic oligonucleotide
ctggagtagactcctgactc

SEQ ID NO: 2108 - DNA, 20 bp, Artificial sequence
  Synthetic oligonucleotide
tcaggaaaaggacagaccct

SEQ ID NO: 2109 - DNA, 20 bp, Artificial sequence
  Synthetic oligonucleotide
ccccggtgacagtgagaact

SEQ ID NO: 2110 - DNA, 20 bp, Artificial sequence
  Synthetic oligonucleotide
gcccaccctgccctatcaca

SEQ ID NO: 2111 - DNA, 20 bp, Artificial sequence
  Synthetic oligonucleotide
gtaatgaggcgggaggagag

SEQ ID NO: 2112 - DNA, 20 bp, Artificial sequence
  Synthetic oligonucleotide
cctgcaaaatgggaccactc

SEQ ID NO: 2113 - DNA, 20 bp, Artificial sequence
  Synthetic oligonucleotide
gaaggaagagcagggagctg

SEQ ID NO: 2114 - DNA, 20 bp, Artificial sequence
  Synthetic oligonucleotide
gtaggcccagggttgcccct

SEQ ID NO: 2115 - DNA, 20 bp, Artificial sequence
  Synthetic oligonucleotide
ttcccaaccatctgctcacc

SEQ ID NO: 2116 - DNA, 20 bp, Artificial sequence
  Synthetic oligonucleotide
cacccctgggcctaaagacc

SEQ ID NO: 2117 - DNA, 20 bp, Artificial sequence
  Synthetic oligonucleotide
ctctcatctgctttccgcac

SEQ ID NO: 2118 - DNA, 20 bp, Artificial sequence
  Synthetic oligonucleotide
cgttgtccgggttcctgtag

SEQ ID NO: 2119 - DNA, 20 bp, Artificial sequence
  Synthetic oligonucleotide
ggtactcgccggtcctgcag

SEQ ID NO: 2120 - DNA, 20 bp, Artificial sequence
  Synthetic oligonucleotide
tctcttcccgtccccgcggg

SEQ ID NO: 2121 - DNA, 20 bp, Artificial sequence
  Synthetic oligonucleotide
ctaacccagtgatcaaaggt

SEQ ID NO: 2122 - DNA, 20 bp, Artificial sequence
  Synthetic oligonucleotide
attctacctgggattcacct

SEQ ID NO: 2123 - DNA, 20 bp, Artificial sequence
  Synthetic oligonucleotide
ctggctcccacactagcccg

SEQ ID NO: 2124 - DNA, 20 bp, Artificial sequence
  Synthetic oligonucleotide
aggctgaggtccagagaaaa

SEQ ID NO: 2125 - DNA, 20 bp, Artificial sequence
  Synthetic oligonucleotide
gccgcccggacgatggacaa

SEQ ID NO: 2126 - DNA, 20 bp, Artificial sequence
  Synthetic oligonucleotide
gtcggaaacacgcagctcag

SEQ ID NO: 2127 - DNA, 20 bp, Artificial sequence
  Synthetic oligonucleotide
catccgtccgttggtccagc

SEQ ID NO: 2128 - DNA, 20 bp, Artificial sequence
  Synthetic oligonucleotide
tccaagctcaccagcaggaa

SEQ ID NO: 2129 - DNA, 20 bp, Artificial sequence
  Synthetic oligonucleotide
ttcagctttgtacttatgct

SEQ ID NO: 2130 - DNA, 20 bp, Artificial sequence
  Synthetic oligonucleotide
gctccccggtgacagtgaga

SEQ ID NO: 2131 - DNA, 20 bp, Artificial sequence
  Synthetic oligonucleotide
ttgtgggtacatttgtggta

SEQ ID NO: 2132 - DNA, 20 bp, Artificial sequence
  Synthetic oligonucleotide
ccccatcgctggtcctgatc

SEQ ID NO: 2133 - DNA, 20 bp, Artificial sequence
  Synthetic oligonucleotide
tgctgcagtggtctttcact

SEQ ID NO: 2134 - DNA, 20 bp, Artificial sequence
  Synthetic oligonucleotide
tgttgtggacagagacagtg

SEQ ID NO: 2135 - DNA, 20 bp, Artificial sequence
  Synthetic oligonucleotide
ggctcaaagcacttctcttt

SEQ ID NO: 2136 - DNA, 20 bp, Artificial sequence
  Synthetic oligonucleotide
ctataccatatctcattctt

SEQ ID NO: 2137 - DNA, 20 bp, Artificial sequence
  Synthetic oligonucleotide
caggacccttgcactggcat

SEQ ID NO: 2138 - DNA, 20 bp, Artificial sequence
  Synthetic oligonucleotide
ggcctggctggccagccgct

SEQ ID NO: 2139 - DNA, 20 bp, Artificial sequence
  Synthetic oligonucleotide
ctaggcagcgacccccatgg

SEQ ID NO: 2140 - DNA, 20 bp, Artificial sequence
  Synthetic oligonucleotide
tccggtgtagcccaccgggc

SEQ ID NO: 2141 - DNA, 20 bp, Artificial sequence
  Synthetic oligonucleotide
tagctgagcccgcggccatc

SEQ ID NO: 2142 - DNA, 20 bp, Artificial sequence
  Synthetic oligonucleotide
cgaggcccacggctgacagg

SEQ ID NO: 2143 - DNA, 20 bp, Artificial sequence
  Synthetic oligonucleotide
gccgcccagtccccagttcc

SEQ ID NO: 2144 - DNA, 20 bp, Artificial sequence
  Synthetic oligonucleotide
tactcccagctcagccggtc

SEQ ID NO: 2145 - DNA, 20 bp, Artificial sequence
  Synthetic oligonucleotide
cggctgcgcgggcatgagtg

SEQ ID NO: 2146 - DNA, 20 bp, Artificial sequence
  Synthetic oligonucleotide
tcccgcttcgccggcaaggc

SEQ ID NO: 2147 - DNA, 20 bp, Artificial sequence
  Synthetic oligonucleotide
cccgcagctcagtgggccgt

SEQ ID NO: 2148 - DNA, 20 bp, Artificial sequence
  Synthetic oligonucleotide
cgcgggtcatcgaagacaga

SEQ ID NO: 2149 - DNA, 20 bp, Artificial sequence
  Synthetic oligonucleotide
gcagaaactgtggccccagt

SEQ ID NO: 2150 - DNA, 20 bp, Artificial sequence
  Synthetic oligonucleotide
caccaccgtcagatcctcgg

SEQ ID NO: 2151 - DNA, 20 bp, Artificial sequence
  Synthetic oligonucleotide
aagcggtaggagcgcacggc

SEQ ID NO: 2152 - DNA, 20 bp, Artificial sequence
  Synthetic oligonucleotide
ctgccgtccgcatcctcctg

SEQ ID NO: 2153 - DNA, 20 bp, Artificial sequence
  Synthetic oligonucleotide
gccggccacctggcagagcg

SEQ ID NO: 2154 - DNA, 20 bp, Artificial sequence
  Synthetic oligonucleotide
tattcctccgccccctcgaa

SEQ ID NO: 2155 - DNA, 20 bp, Artificial sequence
  Synthetic oligonucleotide
cagggagaggaacggtacct

SEQ ID NO: 2156 - DNA, 20 bp, Artificial sequence
  Synthetic oligonucleotide
ccccagctgatgatgccttg

SEQ ID NO: 2157 - DNA, 20 bp, Artificial sequence
  Synthetic oligonucleotide
tgtgctcccggatccaggcc

SEQ ID NO: 2158 - DNA, 20 bp, Artificial sequence
  Synthetic oligonucleotide
tcaccaaggagggaaagatg

SEQ ID NO: 2159 - DNA, 20 bp, Artificial sequence
  Synthetic oligonucleotide
tcctgcgccatcctggcgcg

SEQ ID NO: 2160 - DNA, 20 bp, Artificial sequence
  Synthetic oligonucleotide
atgagcagaggccatggctc

SEQ ID NO: 2161 - DNA, 20 bp, Artificial sequence
  Synthetic oligonucleotide
atccacccagtctggttgtc

SEQ ID NO: 2162 - DNA, 20 bp, Artificial sequence
  Synthetic oligonucleotide
gagatttcttcccaagaccc

SEQ ID NO: 2163 - DNA, 20 bp, Artificial sequence
  Synthetic oligonucleotide
gagagaagaaggcagggaac

SEQ ID NO: 2164 - DNA, 20 bp, Artificial sequence
  Synthetic oligonucleotide
ctagactgccctgagactgc

SEQ ID NO: 2165 - DNA, 20 bp, Artificial sequence
  Synthetic oligonucleotide
agcccataccctgccctcaa

SEQ ID NO: 2166 - DNA, 20 bp, Artificial sequence
  Synthetic oligonucleotide
cctggcctctgtgtggcatg

SEQ ID NO: 2167 - DNA, 20 bp, Artificial sequence
  Synthetic oligonucleotide
cgcccagagtcacccagctc

SEQ ID NO: 2168 - DNA, 20 bp, Artificial sequence
  Synthetic oligonucleotide
ggctgaatacctcacatggg

SEQ ID NO: 2169 - DNA, 20 bp, Artificial sequence
  Synthetic oligonucleotide
tctggaagaatgaaagcaat

SEQ ID NO: 2170 - DNA, 20 bp, Artificial sequence
  Synthetic oligonucleotide
gtcaggcccaccagggtaag

SEQ ID NO: 2171 - DNA, 20 bp, Artificial sequence
  Synthetic oligonucleotide
caaggatagggcaccaagtt

SEQ ID NO: 2172 - DNA, 20 bp, Artificial sequence
  Synthetic oligonucleotide
ccagaactaggacagtaaat

SEQ ID NO: 2173 - DNA, 20 bp, Artificial sequence
  Synthetic oligonucleotide
cttcatgagataatgccatg

SEQ ID NO: 2174 - DNA, 20 bp, Artificial sequence
  Synthetic oligonucleotide
gaacctaatactgtttgcta

SEQ ID NO: 2175 - DNA, 20 bp, Artificial sequence
  Synthetic oligonucleotide
tgctatagtgccatcagctt

SEQ ID NO: 2176 - DNA, 20 bp, Artificial sequence
  Synthetic oligonucleotide
ggatttggcttttggaaatg

SEQ ID NO: 2177 - DNA, 20 bp, Artificial sequence
  Synthetic oligonucleotide
gtgaaaaatttgcacattcc

SEQ ID NO: 2178 - DNA, 20 bp, Artificial sequence
  Synthetic oligonucleotide
ctctggttctacattgagaa

SEQ ID NO: 2179 - DNA, 20 bp, Artificial sequence
  Synthetic oligonucleotide
ataatacttgttgaatgttg

SEQ ID NO: 2180 - DNA, 20 bp, Artificial sequence
  Synthetic oligonucleotide
tagctggagtagactcctga

SEQ ID NO: 2181 - DNA, 20 bp, Artificial sequence
  Synthetic oligonucleotide
tggtcaggaaaaggacagac

SEQ ID NO: 2182 - DNA, 20 bp, Artificial sequence
  Synthetic oligonucleotide
tagtcttaccagggctgagg

SEQ ID NO: 2183 - DNA, 20 bp, Artificial sequence
  Synthetic oligonucleotide
cttccctgctctacccaggg

SEQ ID NO: 2184 - DNA, 20 bp, Artificial sequence
  Synthetic oligonucleotide
agagtaatgaggcgggagga

SEQ ID NO: 2185 - DNA, 20 bp, Artificial sequence
  Synthetic oligonucleotide
ccacctgcaaaatgggacca

SEQ ID NO: 2186 - DNA, 20 bp, Artificial sequence
  Synthetic oligonucleotide
tggtggaaggaagagcaggg

SEQ ID NO: 2187 - DNA, 20 bp, Artificial sequence
  Synthetic oligonucleotide
tctgtaggcccagggttgcc

SEQ ID NO: 2188 - DNA, 20 bp, Artificial sequence
  Synthetic oligonucleotide
ccgttcccaaccatctgctc

SEQ ID NO: 2189 - DNA, 20 bp, Artificial sequence
  Synthetic oligonucleotide
agccacccctgggcctaaag

SEQ ID NO: 2190 - DNA, 20 bp, Artificial sequence
  Synthetic oligonucleotide
tccctctcatctgctttccg

SEQ ID NO: 2191 - DNA, 20 bp, Artificial sequence
  Synthetic oligonucleotide
ccacttcctaacctcccggg

SEQ ID NO: 2192 - DNA, 20 bp, Artificial sequence
  Synthetic oligonucleotide
gcgggtactcgccggtcctg

SEQ ID NO: 2193 - DNA, 20 bp, Artificial sequence
  Synthetic oligonucleotide
agctctcttcccgtccccgc

SEQ ID NO: 2194 - DNA, 20 bp, Artificial sequence
  Synthetic oligonucleotide
cgcctaacccagtgatcaaa

SEQ ID NO: 2195 - DNA, 20 bp, Artificial sequence
  Synthetic oligonucleotide
ggccctgggattctacctgg

SEQ ID NO: 2196 - DNA, 20 bp, Artificial sequence
  Synthetic oligonucleotide
aacctggctcccacactagc

SEQ ID NO: 2197 - DNA, 20 bp, Artificial sequence
  Synthetic oligonucleotide
gcaaggaggctgaggtccag

SEQ ID NO: 2198 - DNA, 20 bp, Artificial sequence
  Synthetic oligonucleotide
cttgccgcccggacgatgga

SEQ ID NO: 2199 - DNA, 20 bp, Artificial sequence
  Synthetic oligonucleotide
tgggtcggaaacacgcagct

SEQ ID NO: 2200 - DNA, 20 bp, Artificial sequence
  Synthetic oligonucleotide
ggcatccgtccgttggtcca

SEQ ID NO: 2201 - DNA, 20 bp, Artificial sequence
  Synthetic oligonucleotide
ctccaagctcaccagcagga

SEQ ID NO: 2202 - DNA, 20 bp, Artificial sequence
  Synthetic oligonucleotide
cttcagctttgtacttatgc

SEQ ID NO: 2203 - DNA, 20 bp, Artificial sequence
  Synthetic oligonucleotide
gggctccccggtgacagtga

SEQ ID NO: 2204 - DNA, 20 bp, Artificial sequence
  Synthetic oligonucleotide
cttgtgggtacatttgtggt

SEQ ID NO: 2205 - DNA, 20 bp, Artificial sequence
  Synthetic oligonucleotide
tccccatcgctggtcctgat

SEQ ID NO: 2206 - DNA, 20 bp, Artificial sequence
  Synthetic oligonucleotide
ttgctgcagtggtctttcac

SEQ ID NO: 2207 - DNA, 20 bp, Artificial sequence
  Synthetic oligonucleotide
gtgttgtggacagagacagt

SEQ ID NO: 2208 - DNA, 20 bp, Artificial sequence
  Synthetic oligonucleotide
aggctcaaagcacttctctt

SEQ ID NO: 2209 - DNA, 20 bp, Artificial sequence
  Synthetic oligonucleotide
ttctataccatatctcattc

SEQ ID NO: 2210 - DNA, 20 bp, Artificial sequence
  Synthetic oligonucleotide
tcaggacccttgcactggca

SEQ ID NO: 2211 - DNA, 20 bp, Artificial sequence
  Synthetic oligonucleotide
caggcctggctggccagccg

SEQ ID NO: 2212 - DNA, 20 bp, Artificial sequence
  Synthetic oligonucleotide
ctctaggcagcgacccccat

SEQ ID NO: 2213 - DNA, 20 bp, Artificial sequence
  Synthetic oligonucleotide
ctccggtgtagcccaccggg

SEQ ID NO: 2214 - DNA, 20 bp, Artificial sequence
  Synthetic oligonucleotide
ggtagctgagcccgcggcca

SEQ ID NO: 2215 - DNA, 20 bp, Artificial sequence
  Synthetic oligonucleotide
ccgaggcccacggctgacag

SEQ ID NO: 2216 - DNA, 20 bp, Artificial sequence
  Synthetic oligonucleotide
gtggccgcccagtccccagt

SEQ ID NO: 2217 - DNA, 20 bp, Artificial sequence
  Synthetic oligonucleotide
gtactcccagctcagccggt

SEQ ID NO: 2218 - DNA, 20 bp, Artificial sequence
  Synthetic oligonucleotide
ccggctgcgcgggcatgagt

SEQ ID NO: 2219 - DNA, 20 bp, Artificial sequence
  Synthetic oligonucleotide
ctcccgcttcgccggcaagg

SEQ ID NO: 2220 - DNA, 20 bp, Artificial sequence
  Synthetic oligonucleotide
ctgcccgcagctcagtgggc

SEQ ID NO: 2221 - DNA, 20 bp, Artificial sequence
  Synthetic oligonucleotide
gacgcgggtcatcgaagaca

SEQ ID NO: 2222 - DNA, 20 bp, Artificial sequence
  Synthetic oligonucleotide
cgcagaaactgtggccccag

SEQ ID NO: 2223 - DNA, 20 bp, Artificial sequence
  Synthetic oligonucleotide
gcaccaccgtcagatcctcg

SEQ ID NO: 2224 - DNA, 20 bp, Artificial sequence
  Synthetic oligonucleotide
caagcggtaggagcgcacgg

SEQ ID NO: 2225 - DNA, 20 bp, Artificial sequence
  Synthetic oligonucleotide
gctgccgtccgcatcctcct

SEQ ID NO: 2226 - DNA, 20 bp, Artificial sequence
  Synthetic oligonucleotide
cagccggccacctggcagag

SEQ ID NO: 2227 - DNA, 20 bp, Artificial sequence
  Synthetic oligonucleotide
atattcctccgccccctcga

SEQ ID NO: 2228 - DNA, 20 bp, Artificial sequence
  Synthetic oligonucleotide
ccagggagaggaacggtacc

SEQ ID NO: 2229 - DNA, 20 bp, Artificial sequence
  Synthetic oligonucleotide
tccccagctgatgatgcctt

SEQ ID NO: 2230 - DNA, 20 bp, Artificial sequence
  Synthetic oligonucleotide
gcctggcttgttgcggtcac

SEQ ID NO: 2231 - DNA, 20 bp, Artificial sequence
  Synthetic oligonucleotide
gtgtgctcccggatccaggc

SEQ ID NO: 2232 - DNA, 20 bp, Artificial sequence
  Synthetic oligonucleotide
aatcaccaaggagggaaaga

SEQ ID NO: 2233 - DNA, 20 bp, Artificial sequence
  Synthetic oligonucleotide
ttgccttccatgccccagcc

SEQ ID NO: 2234 - DNA, 20 bp, Artificial sequence
  Synthetic oligonucleotide
gttcctgcgccatcctggcg

SEQ ID NO: 2235 - DNA, 20 bp, Artificial sequence
  Synthetic oligonucleotide
ccgaaagtgttgactccaag

SEQ ID NO: 2236 - DNA, 20 bp, Artificial sequence
  Synthetic oligonucleotide
gtcatgagcagaggccatgg

SEQ ID NO: 2237 - DNA, 20 bp, Artificial sequence
  Synthetic oligonucleotide
tgtatccacccagtctggtt

SEQ ID NO: 2238 - DNA, 20 bp, Artificial sequence
  Synthetic oligonucleotide
gcagagatttcttcccaaga

SEQ ID NO: 2239 - DNA, 20 bp, Artificial sequence
  Synthetic oligonucleotide
caagggagagaagaaggcag

SEQ ID NO: 2240 - DNA, 20 bp, Artificial sequence
  Synthetic oligonucleotide
agactagactgccctgagac

SEQ ID NO: 2241 - DNA, 20 bp, Artificial sequence
  Synthetic oligonucleotide
cacagcccataccctgccct

SEQ ID NO: 2242 - DNA, 20 bp, Artificial sequence
  Synthetic oligonucleotide
ggccctggcctctgtgtggc

SEQ ID NO: 2243 - DNA, 20 bp, Artificial sequence
  Synthetic oligonucleotide
ccctcgcccagagtcaccca

SEQ ID NO: 2244 - DNA, 20 bp, Artificial sequence
  Synthetic oligonucleotide
atgggctgaatacctcacat

SEQ ID NO: 2245 - DNA, 20 bp, Artificial sequence
  Synthetic oligonucleotide
gtgtctggaagaatgaaagc

SEQ ID NO: 2246 - DNA, 20 bp, Artificial sequence
  Synthetic oligonucleotide
caagtcaggcccaccagggt

SEQ ID NO: 2247 - DNA, 20 bp, Artificial sequence
  Synthetic oligonucleotide
aggcaaggatagggcaccaa

SEQ ID NO: 2248 - DNA, 20 bp, Artificial sequence
  Synthetic oligonucleotide
aaaccagaactaggacagta

SEQ ID NO: 2249 - DNA, 20 bp, Artificial sequence
  Synthetic oligonucleotide
gggcttcatgagataatgcc

SEQ ID NO: 2250 - DNA, 20 bp, Artificial sequence
  Synthetic oligonucleotide
caggaacctaatactgtttg

SEQ ID NO: 2251 - DNA, 20 bp, Artificial sequence
  Synthetic oligonucleotide
gtgtgctatagtgccatcag

SEQ ID NO: 2252 - DNA, 20 bp, Artificial sequence
  Synthetic oligonucleotide
cactttgtgcttttgctggg

SEQ ID NO: 2253 - DNA, 20 bp, Artificial sequence
  Synthetic oligonucleotide
gcagtgaaaaatttgcacat

SEQ ID NO: 2254 - DNA, 20 bp, Artificial sequence
  Synthetic oligonucleotide
cttctctggttctacattga

SEQ ID NO: 2255 - DNA, 20 bp, Artificial sequence
  Synthetic oligonucleotide
cttaataatacttgttgaat

SEQ ID NO: 2256 - DNA, 20 bp, Artificial sequence
  Synthetic oligonucleotide
agatagctggagtagactcc

SEQ ID NO: 2257 - DNA, 20 bp, Artificial sequence
  Synthetic oligonucleotide
gtctggtcaggaaaaggaca

SEQ ID NO: 2258 - DNA, 20 bp, Artificial sequence
  Synthetic oligonucleotide
cctgctccaactcctctgcg

SEQ ID NO: 2259 - DNA, 20 bp, Artificial sequence
  Synthetic oligonucleotide
aggcttccctgctctaccca

SEQ ID NO: 2260 - DNA, 20 bp, Artificial sequence
  Synthetic oligonucleotide
aggagagtaatgaggcggga

SEQ ID NO: 2261 - DNA, 20 bp, Artificial sequence
  Synthetic oligonucleotide
ggtttacccacctgcaaaat

SEQ ID NO: 2262 - DNA, 20 bp, Artificial sequence
  Synthetic oligonucleotide
acatggtggaaggaagagca

SEQ ID NO: 2263 - DNA, 20 bp, Artificial sequence
  Synthetic oligonucleotide
tattctgtaggcccagggtt

SEQ ID NO: 2264 - DNA, 20 bp, Artificial sequence
  Synthetic oligonucleotide
ggcccgttcccaaccatctg

SEQ ID NO: 2265 - DNA, 20 bp, Artificial sequence
  Synthetic oligonucleotide
gtgagccacccctgggccta

SEQ ID NO: 2266 - DNA, 20 bp, Artificial sequence
  Synthetic oligonucleotide
tgcctccctctcatctgctt

SEQ ID NO: 2267 - DNA, 20 bp, Artificial sequence
  Synthetic oligonucleotide
cccccacttcctaacctccc

SEQ ID NO: 2268 - DNA, 20 bp, Artificial sequence
  Synthetic oligonucleotide
gaggagccgcggcccctggg

SEQ ID NO: 2269 - DNA, 20 bp, Artificial sequence
  Synthetic oligonucleotide
ccaagctctcttcccgtccc

SEQ ID NO: 2270 - DNA, 20 bp, Artificial sequence
  Synthetic oligonucleotide
ttccgcctaacccagtgatc

SEQ ID NO: 2271 - DNA, 20 bp, Artificial sequence
  Synthetic oligonucleotide
ccaggccctgggattctacc

SEQ ID NO: 2272 - DNA, 20 bp, Artificial sequence
  Synthetic oligonucleotide
cagaacctggctcccacact

SEQ ID NO: 2273 - DNA, 20 bp, Artificial sequence
  Synthetic oligonucleotide
taggcaaggaggctgaggtc

SEQ ID NO: 2274 - DNA, 20 bp, Artificial sequence
  Synthetic oligonucleotide
acgcttgccgcccggacgat

SEQ ID NO: 2275 - DNA, 20 bp, Artificial sequence
  Synthetic oligonucleotide
ccctgggtcggaaacacgca

SEQ ID NO: 2276 - DNA, 20 bp, Artificial sequence
  Synthetic oligonucleotide
tggcatccgtccgttggtcc

SEQ ID NO: 2277 - DNA, 20 bp, Artificial sequence
  Synthetic oligonucleotide
gactccaagctcaccagcag

SEQ ID NO: 2278 - DNA, 20 bp, Artificial sequence
  Synthetic oligonucleotide
tcttcagctttgtacttatg

SEQ ID NO: 2279 - DNA, 20 bp, Artificial sequence
  Synthetic oligonucleotide
agggctccccggtgacagtg

SEQ ID NO: 2280 - DNA, 20 bp, Artificial sequence
  Synthetic oligonucleotide
cccttgtgggtacatttgtg

SEQ ID NO: 2281 - DNA, 20 bp, Artificial sequence
  Synthetic oligonucleotide
atccccatcgctggtcctga

SEQ ID NO: 2282 - DNA, 20 bp, Artificial sequence
  Synthetic oligonucleotide
tttgctgcagtggtctttca

SEQ ID NO: 2283 - DNA, 20 bp, Artificial sequence
  Synthetic oligonucleotide
ggtgttgtggacagagacag

SEQ ID NO: 2284 - DNA, 20 bp, Artificial sequence
  Synthetic oligonucleotide
gaggctcaaagcacttctct

SEQ ID NO: 2285 - DNA, 20 bp, Artificial sequence
  Synthetic oligonucleotide
gttctataccatatctcatt

SEQ ID NO: 2286 - DNA, 20 bp, Artificial sequence
  Synthetic oligonucleotide
atcaggacccttgcactggc

SEQ ID NO: 2287 - DNA, 20 bp, Artificial sequence
  Synthetic oligonucleotide
gcaggcctggctggccagcc

SEQ ID NO: 2288 - DNA, 20 bp, Artificial sequence
  Synthetic oligonucleotide
cctctaggcagcgaccccca

SEQ ID NO: 2289 - DNA, 20 bp, Artificial sequence
  Synthetic oligonucleotide
ggctccggtgtagcccaccg

SEQ ID NO: 2290 - DNA, 20 bp, Artificial sequence
  Synthetic oligonucleotide
cggtagctgagcccgcggcc

SEQ ID NO: 2291 - DNA, 20 bp, Artificial sequence
  Synthetic oligonucleotide
tccgaggcccacggctgaca

SEQ ID NO: 2292 - DNA, 20 bp, Artificial sequence
  Synthetic oligonucleotide
gggttccggcagaaggcgtg

SEQ ID NO: 2293 - DNA, 20 bp, Artificial sequence
  Synthetic oligonucleotide
cagtactcccagctcagccg

SEQ ID NO: 2294 - DNA, 20 bp, Artificial sequence
  Synthetic oligonucleotide
gccggctgcgcgggcatgag

SEQ ID NO: 2295 - DNA, 20 bp, Artificial sequence
  Synthetic oligonucleotide
tgctcccgcttcgccggcaa

SEQ ID NO: 2296 - DNA, 20 bp, Artificial sequence
  Synthetic oligonucleotide
cgctgcccgcagctcagtgg

SEQ ID NO: 2297 - DNA, 20 bp, Artificial sequence
  Synthetic oligonucleotide
cgacgcgggtcatcgaagac

SEQ ID NO: 2298 - DNA, 20 bp, Artificial sequence
  Synthetic oligonucleotide
agcaccaccgtcagatcctc

SEQ ID NO: 2299 - DNA, 20 bp, Artificial sequence
  Synthetic oligonucleotide
gcaagcggtaggagcgcacg

SEQ ID NO: 2300 - DNA, 20 bp, Artificial sequence
  Synthetic oligonucleotide
ccccagccggccacctggca

SEQ ID NO: 2301 - DNA, 20 bp, Artificial sequence
  Synthetic oligonucleotide
gcatattcctccgccccctc

SEQ ID NO: 2302 - DNA, 20 bp, Artificial sequence
  Synthetic oligonucleotide
tccagggagaggaacggtac

SEQ ID NO: 2303 - DNA, 20 bp, Artificial sequence
  Synthetic oligonucleotide
tggtcctcacacaccagcgg

SEQ ID NO: 2304 - DNA, 20 bp, Artificial sequence
  Synthetic oligonucleotide
atccccagctgatgatgcct

SEQ ID NO: 2305 - DNA, 20 bp, Artificial sequence
  Synthetic oligonucleotide
cgcctggcttgttgcggtca

SEQ ID NO: 2306 - DNA, 20 bp, Artificial sequence
  Synthetic oligonucleotide
ggtgtgctcccggatccagg

SEQ ID NO: 2307 - DNA, 20 bp, Artificial sequence
  Synthetic oligonucleotide
gaatcaccaaggagggaaag

SEQ ID NO: 2308 - DNA, 20 bp, Artificial sequence
  Synthetic oligonucleotide
cttgccttccatgccccagc

SEQ ID NO: 2309 - DNA, 20 bp, Artificial sequence
  Synthetic oligonucleotide
agttcctgcgccatcctggc

SEQ ID NO: 2310 - DNA, 20 bp, Artificial sequence
  Synthetic oligonucleotide
tcaccgaaagtgttgactcc

SEQ ID NO: 2311 - DNA, 20 bp, Artificial sequence
  Synthetic oligonucleotide
caggtcatgagcagaggcca

SEQ ID NO: 2312 - DNA, 20 bp, Artificial sequence
  Synthetic oligonucleotide
ccttgtatccacccagtctg

SEQ ID NO: 2313 - DNA, 20 bp, Artificial sequence
  Synthetic oligonucleotide
agaaatgcagagatttcttc

SEQ ID NO: 2314 - DNA, 20 bp, Artificial sequence
  Synthetic oligonucleotide
ctacaagggagagaagaagg

SEQ ID NO: 2315 - DNA, 20 bp, Artificial sequence
  Synthetic oligonucleotide
actagactagactgccctga

SEQ ID NO: 2316 - DNA, 20 bp, Artificial sequence
  Synthetic oligonucleotide
agacacagcccataccctgc

SEQ ID NO: 2317 - DNA, 20 bp, Artificial sequence
  Synthetic oligonucleotide
gaaggccctggcctctgtgt

SEQ ID NO: 2318 - DNA, 20 bp, Artificial sequence
  Synthetic oligonucleotide
aatccctcgcccagagtcac

SEQ ID NO: 2319 - DNA, 20 bp, Artificial sequence
  Synthetic oligonucleotide
gtgatgggctgaatacctca

SEQ ID NO: 2320 - DNA, 20 bp, Artificial sequence
  Synthetic oligonucleotide
ttagtgtctggaagaatgaa

SEQ ID NO: 2321 - DNA, 20 bp, Artificial sequence
  Synthetic oligonucleotide
caccaagtcaggcccaccag

SEQ ID NO: 2322 - DNA, 20 bp, Artificial sequence
  Synthetic oligonucleotide
attaggcaaggatagggcac

SEQ ID NO: 2323 - DNA, 20 bp, Artificial sequence
  Synthetic oligonucleotide
accaaaccagaactaggaca

SEQ ID NO: 2324 - DNA, 20 bp, Artificial sequence
  Synthetic oligonucleotide
cttcttcagaggaattgtcg

SEQ ID NO: 2325 - DNA, 20 bp, Artificial sequence
  Synthetic oligonucleotide
tcacaggaacctaatactgt

SEQ ID NO: 2326 - DNA, 20 bp, Artificial sequence
  Synthetic oligonucleotide
ggtgtgtgctatagtgccat

SEQ ID NO: 2327 - DNA, 20 bp, Artificial sequence
  Synthetic oligonucleotide
tcacactttgtgcttttgct

SEQ ID NO: 2328 - DNA, 20 bp, Artificial sequence
  Synthetic oligonucleotide
agagcagtgaaaaatttgca

SEQ ID NO: 2329 - DNA, 20 bp, Artificial sequence
  Synthetic oligonucleotide
attcttctctggttctacat

SEQ ID NO: 2330 - DNA, 20 bp, Artificial sequence
  Synthetic oligonucleotide
gcacttaataatacttgttg

SEQ ID NO: 2331 - DNA, 20 bp, Artificial sequence
  Synthetic oligonucleotide
gtcagatagctggagtagac

SEQ ID NO: 2332 - DNA, 20 bp, Artificial sequence
  Synthetic oligonucleotide
agggtctggtcaggaaaagg

SEQ ID NO: 2333 - DNA, 20 bp, Artificial sequence
  Synthetic oligonucleotide
gcccctgctccaactcctct

SEQ ID NO: 2334 - DNA, 20 bp, Artificial sequence
  Synthetic oligonucleotide
acaaggcttccctgctctac

SEQ ID NO: 2335 - DNA, 20 bp, Artificial sequence
  Synthetic oligonucleotide
accaggagagtaatgaggcg

SEQ ID NO: 2336 - DNA, 20 bp, Artificial sequence
  Synthetic oligonucleotide
cttggtttacccacctgcaa

SEQ ID NO: 2337 - DNA, 20 bp, Artificial sequence
  Synthetic oligonucleotide
tggacatggtggaaggaaga

SEQ ID NO: 2338 - DNA, 20 bp, Artificial sequence
  Synthetic oligonucleotide
acctattctgtaggcccagg

SEQ ID NO: 2339 - DNA, 20 bp, Artificial sequence
  Synthetic oligonucleotide
cctggcccgttcccaaccat

SEQ ID NO: 2340 - DNA, 20 bp, Artificial sequence
  Synthetic oligonucleotide
gcagtgagccacccctgggc

SEQ ID NO: 2341 - DNA, 20 bp, Artificial sequence
  Synthetic oligonucleotide
tcctgcctccctctcatctg

SEQ ID NO: 2342 - DNA, 20 bp, Artificial sequence
  Synthetic oligonucleotide
ccccccccacttcctaacct

SEQ ID NO: 2343 - DNA, 20 bp, Artificial sequence
  Synthetic oligonucleotide
acggaggagccgcggcccct

SEQ ID NO: 2344 - DNA, 20 bp, Artificial sequence
  Synthetic oligonucleotide
gccccaagctctcttcccgt

SEQ ID NO: 2345 - DNA, 20 bp, Artificial sequence
  Synthetic oligonucleotide
ttcttccgcctaacccagtg

SEQ ID NO: 2346 - DNA, 20 bp, Artificial sequence
  Synthetic oligonucleotide
atcccaggccctgggattct

SEQ ID NO: 2347 - DNA, 20 bp, Artificial sequence
  Synthetic oligonucleotide
tcgcagaacctggctcccac

SEQ ID NO: 2348 - DNA, 20 bp, Artificial sequence
  Synthetic oligonucleotide
tcataggcaaggaggctgag

SEQ ID NO: 2349 - DNA, 20 bp, Artificial sequence
  Synthetic oligonucleotide
cacaccccatctgacaacgc

SEQ ID NO: 2350 - DNA, 20 bp, Artificial sequence
  Synthetic oligonucleotide
tcaccctgggtcggaaacac

SEQ ID NO: 2351 - DNA, 20 bp, Artificial sequence
  Synthetic oligonucleotide
ttgctagttcaatgttcact

SEQ ID NO: 2352 - DNA, 20 bp, Artificial sequence
  Synthetic oligonucleotide
tttgctagttcaatgttcac

SEQ ID NO: 2353 - DNA, 20 bp, Artificial sequence
  Synthetic oligonucleotide
tgtttgctagttcaatgttc

SEQ ID NO: 2354 - DNA, 20 bp, Artificial sequence
  Synthetic oligonucleotide
ctgtttgctagttcaatgtt

SEQ ID NO: 2355 - DNA, 20 bp, Artificial sequence
  Synthetic oligonucleotide
tactgtttgctagttcaatg

SEQ ID NO: 2356 - DNA, 20 bp, Artificial sequence
  Synthetic oligonucleotide
atactgtttgctagttcaat

SEQ ID NO: 2357 - DNA, 20 bp, Artificial sequence
  Synthetic oligonucleotide
taatactgtttgctagttca

SEQ ID NO: 2358 - DNA, 20 bp, Artificial sequence
  Synthetic oligonucleotide
ctaatactgtttgctagttc

SEQ ID NO: 2359 - DNA, 20 bp, Artificial sequence
  Synthetic oligonucleotide
tcccagttaaggttcaacaa

SEQ ID NO: 2360 - DNA, 20 bp, Artificial sequence
  Synthetic oligonucleotide
ttcccagttaaggttcaaca

SEQ ID NO: 2361 - DNA, 20 bp, Artificial sequence
  Synthetic oligonucleotide
cattcccagttaaggttcaa

SEQ ID NO: 2362 - DNA, 20 bp, Artificial sequence
  Synthetic oligonucleotide
acattcccagttaaggttca

SEQ ID NO: 2363 - DNA, 20 bp, Artificial sequence
  Synthetic oligonucleotide
gcacattcccagttaaggtt

SEQ ID NO: 2364 - DNA, 20 bp, Artificial sequence
  Synthetic oligonucleotide
tgcacattcccagttaaggt

SEQ ID NO: 2365 - DNA, 20 bp, Artificial sequence
  Synthetic oligonucleotide
tttgcacattcccagttaag

SEQ ID NO: 2366 - DNA, 20 bp, Artificial sequence
  Synthetic oligonucleotide
atttgcacattcccagttaa

SEQ ID NO: 2367 - DNA, 20 bp, Artificial sequence
  Synthetic oligonucleotide
ttccaagcttggtttaccca

SEQ ID NO: 2368 - DNA, 20 bp, Artificial sequence
  Synthetic oligonucleotide
tttccaagcttggtttaccc

SEQ ID NO: 2369 - DNA, 20 bp, Artificial sequence
  Synthetic oligonucleotide
agtttccaagcttggtttac

SEQ ID NO: 2370 - DNA, 20 bp, Artificial sequence
  Synthetic oligonucleotide
aagtttccaagcttggttta

SEQ ID NO: 2371 - DNA, 20 bp, Artificial sequence
  Synthetic oligonucleotide
ccaagtttccaagcttggtt

SEQ ID NO: 2372 - DNA, 20 bp, Artificial sequence
  Synthetic oligonucleotide
tccaagtttccaagcttggt

SEQ ID NO: 2373 - DNA, 20 bp, Artificial sequence
  Synthetic oligonucleotide
actccaagtttccaagcttg

SEQ ID NO: 2374 - DNA, 20 bp, Artificial sequence
  Synthetic oligonucleotide
tactccaagtttccaagctt

SEQ ID NO: 2375 - DNA, 20 bp, Artificial sequence
  Synthetic oligonucleotide
gccttggtgtctgaggagaa

SEQ ID NO: 2376 - DNA, 20 bp, Artificial sequence
  Synthetic oligonucleotide
tgccttggtgtctgaggaga

SEQ ID NO: 2377 - DNA, 20 bp, Artificial sequence
  Synthetic oligonucleotide
cttgccttggtgtctgagga

SEQ ID NO: 2378 - DNA, 20 bp, Artificial sequence
  Synthetic oligonucleotide
gcttgccttggtgtctgagg

SEQ ID NO: 2379 - DNA, 20 bp, Artificial sequence
  Synthetic oligonucleotide
cagcttgccttggtgtctga

SEQ ID NO: 2380 - DNA, 20 bp, Artificial sequence
  Synthetic oligonucleotide
gcagcttgccttggtgtctg

SEQ ID NO: 2381 - DNA, 20 bp, Artificial sequence
  Synthetic oligonucleotide
tagcagcttgccttggtgtc

SEQ ID NO: 2382 - DNA, 20 bp, Artificial sequence
  Synthetic oligonucleotide
atagcagcttgccttggtgt

SEQ ID NO: 2383 - DNA, 20 bp, Artificial sequence
  Synthetic oligonucleotide
accaagagcaagttcgattc

SEQ ID NO: 2384 - DNA, 20 bp, Artificial sequence
  Synthetic oligonucleotide
aaccaagagcaagttcgatt

SEQ ID NO: 2385 - DNA, 20 bp, Artificial sequence
  Synthetic oligonucleotide
ggaaccaagagcaagttcga

SEQ ID NO: 2386 - DNA, 20 bp, Artificial sequence
  Synthetic oligonucleotide
gggaaccaagagcaagttcg

SEQ ID NO: 2387 - DNA, 20 bp, Artificial sequence
  Synthetic oligonucleotide
gagggaaccaagagcaagtt

SEQ ID NO: 2388 - DNA, 20 bp, Artificial sequence
  Synthetic oligonucleotide
agagggaaccaagagcaagt

SEQ ID NO: 2389 - DNA, 20 bp, Artificial sequence
  Synthetic oligonucleotide
cagagggaaccaagagcaag

SEQ ID NO: 2390 - DNA, 20 bp, Artificial sequence
  Synthetic oligonucleotide
ccagagggaaccaagagcaa

SEQ ID NO: 2391 - DNA, 20 bp, Artificial sequence
  Synthetic oligonucleotide
cccagagggaaccaagagca

SEQ ID NO: 2392 - DNA, 20 bp, Artificial sequence
  Synthetic oligonucleotide
ttgtggtacagctgccggtg

SEQ ID NO: 2393 - DNA, 20 bp, Artificial sequence
  Synthetic oligonucleotide
atcaccaaggagggaaagat

SEQ ID NO: 2394 - DNA, 20 bp, Artificial sequence
  Synthetic oligonucleotide
actgcggaatcaccaaggag

SEQ ID NO: 2395 - DNA, 20 bp, Artificial sequence
  Synthetic oligonucleotide
ctctcactgcggaatcacca

SEQ ID NO: 2396 - DNA, 20 bp, Artificial sequence
  Synthetic oligonucleotide
cactctctcactgcggaatc

SEQ ID NO: 2397 - DNA, 20 bp, Artificial sequence
  Synthetic oligonucleotide
gccactctctcactgcggaa

SEQ ID NO: 2398 - DNA, 20 bp, Artificial sequence
  Synthetic oligonucleotide
ccagccactctctcactgcg

SEQ ID NO: 2399 - DNA, 20 bp, Artificial sequence
  Synthetic oligonucleotide
accgactgtgtgctcttcag

SEQ ID NO: 2400 - DNA, 20 bp, Artificial sequence
  Synthetic oligonucleotide
taccgactgtgtgctcttca

SEQ ID NO: 2401 - DNA, 20 bp, Artificial sequence
  Synthetic oligonucleotide
cttaccgactgtgtgctctt

SEQ ID NO: 2402 - DNA, 20 bp, Artificial sequence
  Synthetic oligonucleotide
acttaccgactgtgtgctct

SEQ ID NO: 2403 - DNA, 20 bp, Artificial sequence
  Synthetic oligonucleotide
agttcaatgttcactgtgat

SEQ ID NO: 2404 - DNA, 20 bp, Artificial sequence
  Synthetic oligonucleotide
ggaacctaatactgtttgct

SEQ ID NO: 2405 - DNA, 20 bp, Artificial sequence
  Synthetic oligonucleotide
gttaaggttcaacaaggcgt

SEQ ID NO: 2406 - DNA, 20 bp, Artificial sequence
  Synthetic oligonucleotide
gaaaaatttgcacattccca

SEQ ID NO: 2407 - DNA, 20 bp, Artificial sequence
  Synthetic oligonucleotide
agcttggtttacccacctgc

SEQ ID NO: 2408 - DNA, 20 bp, Artificial sequence
  Synthetic oligonucleotide
cttgctactccaagtttcca

SEQ ID NO: 2409 - DNA, 20 bp, Artificial sequence
  Synthetic oligonucleotide
ggtgtctgaggagaaagggg

SEQ ID NO: 2410 - DNA, 20 bp, Artificial sequence
  Synthetic oligonucleotide
gagcaagttcgattctccct

SEQ ID NO: 2411 - DNA, 20 bp, Artificial sequence
  Synthetic oligonucleotide
cggcgcccagagggaaccaa

SEQ ID NO: 2412 - DNA, 20 bp, Artificial sequence
  Synthetic oligonucleotide
tttctcagcattttcaaagc

SEQ ID NO: 2413 - DNA, 20 bp, Artificial sequence
  Synthetic oligonucleotide
tctcagcattttcaaagcac

SEQ ID NO: 2414 - DNA, 20 bp, Artificial sequence
  Synthetic oligonucleotide
ttttttctcagcattttcaa

SEQ ID NO: 2415 - DNA, 20 bp, Artificial sequence
  Synthetic oligonucleotide
tttttttctcagcattttca

SEQ ID NO: 2416 - DNA, 20 bp, Artificial sequence
  Synthetic oligonucleotide
tatccaggagtccagatcaa

SEQ ID NO: 2417 - DNA, 20 bp, Artificial sequence
  Synthetic oligonucleotide
agccctcatggcatccgtcc

SEQ ID NO: 2418 - DNA, 20 bp, Artificial sequence
  Synthetic oligonucleotide
gttggtccagctgcctatcc

SEQ ID NO: 2419 - DNA, 20 bp, Artificial sequence
  Synthetic oligonucleotide
cgttggtccagctgcctatc

SEQ ID NO: 2420 - DNA, 20 bp, Artificial sequence
  Synthetic oligonucleotide
tccgtccgttggtccagctg

SEQ ID NO: 2421 - DNA, 16 bp, Artificial sequence
  Synthetic oligonucleotide
aggagtccagatcaat

SEQ ID NO: 2422 - DNA, 16 bp, Artificial sequence
  Synthetic oligonucleotide
actccaagctcaccag

SEQ ID NO: 2423 - DNA, 16 bp, Artificial sequence
  Synthetic oligonucleotide
acttatgctccttggg

SEQ ID NO: 2424 - DNA, 16 bp, Artificial sequence
  Synthetic oligonucleotide
gtgagaacgactgtgt

SEQ ID NO: 2425 - DNA, 16 bp, Artificial sequence
  Synthetic oligonucleotide
gccggtggtactggaa

SEQ ID NO: 2426 - DNA, 16 bp, Artificial sequence
  Synthetic oligonucleotide
tacatttgtggtacag

SEQ ID NO: 2427 - DNA, 16 bp, Artificial sequence
  Synthetic oligonucleotide
cggcccttgtgggtac

SEQ ID NO: 2428 - DNA, 16 bp, Artificial sequence
  Synthetic oligonucleotide
tatccccatcgctggt

SEQ ID NO: 2429 - DNA, 16 bp, Artificial sequence
  Synthetic oligonucleotide
gaggtgttgtggacag

SEQ ID NO: 2430 - DNA, 16 bp, Artificial sequence
  Synthetic oligonucleotide
atatctcattcttgtg

SEQ ID NO: 2431 - DNA, 16 bp, Artificial sequence
  Synthetic oligonucleotide
ggcagtgggcatcagg

SEQ ID NO: 2432 - DNA, 16 bp, Artificial sequence
  Synthetic oligonucleotide
gcgacccccatggagg

SEQ ID NO: 2433 - DNA, 16 bp, Artificial sequence
  Synthetic oligonucleotide
gcagtggcacaggcgg

SEQ ID NO: 2434 - DNA, 16 bp, Artificial sequence
  Synthetic oligonucleotide
gtcgcagaaggctccg

SEQ ID NO: 2435 - DNA, 16 bp, Artificial sequence
  Synthetic oligonucleotide
cgcggtagctgagccc

SEQ ID NO: 2436 - DNA, 16 bp, Artificial sequence
  Synthetic oligonucleotide
gcccacggctgacagg

SEQ ID NO: 2437 - DNA, 16 bp, Artificial sequence
  Synthetic oligonucleotide
cagttccgcgcttgct

SEQ ID NO: 2438 - DNA, 16 bp, Artificial sequence
  Synthetic oligonucleotide
accacgggcggatgtc

SEQ ID NO: 2439 - DNA, 16 bp, Artificial sequence
  Synthetic oligonucleotide
gctcagccggtcgcgg

SEQ ID NO: 2440 - DNA, 16 bp, Artificial sequence
  Synthetic oligonucleotide
catgagtgggacatga

SEQ ID NO: 2441 - DNA, 16 bp, Artificial sequence
  Synthetic oligonucleotide
tctgggactgaggcgg

SEQ ID NO: 2442 - DNA, 16 bp, Artificial sequence
  Synthetic oligonucleotide
gtcagggaaggcggct

SEQ ID NO: 2443 - DNA, 16 bp, Artificial sequence
  Synthetic oligonucleotide
cttgcggagccgctgc

SEQ ID NO: 2444 - DNA, 16 bp, Artificial sequence
  Synthetic oligonucleotide
acgcgggtcatcgaag

SEQ ID NO: 2445 - DNA, 16 bp, Artificial sequence
  Synthetic oligonucleotide
cagtacagcgcggcga

SEQ ID NO: 2446 - DNA, 16 bp, Artificial sequence
  Synthetic oligonucleotide
gatgaggctgccggcg

SEQ ID NO: 2447 - DNA, 16 bp, Artificial sequence
  Synthetic oligonucleotide
ggccgagcaccaccgt

SEQ ID NO: 2448 - DNA, 16 bp, Artificial sequence
  Synthetic oligonucleotide
gtgcaagcggtaggag

SEQ ID NO: 2449 - DNA, 16 bp, Artificial sequence
  Synthetic oligonucleotide
ctgaaggcgcaacaga

SEQ ID NO: 2450 - DNA, 16 bp, Artificial sequence
  Synthetic oligonucleotide
gcgcgcagctgccgtc

SEQ ID NO: 2451 - DNA, 16 bp, Artificial sequence
  Synthetic oligonucleotide
ggcaggcacaccggct

SEQ ID NO: 2452 - DNA, 16 bp, Artificial sequence
  Synthetic oligonucleotide
ctggtggccccagccg

SEQ ID NO: 2453 - DNA, 16 bp, Artificial sequence
  Synthetic oligonucleotide
catattcctccgcccc

SEQ ID NO: 2454 - DNA, 16 bp, Artificial sequence
  Synthetic oligonucleotide
gggagaggaacggtac

SEQ ID NO: 2455 - DNA, 16 bp, Artificial sequence
  Synthetic oligonucleotide
ctcgaggaaccctgcg

SEQ ID NO: 2456 - DNA, 16 bp, Artificial sequence
  Synthetic oligonucleotide
ggtcctcacacaccag

SEQ ID NO: 2457 - DNA, 16 bp, Artificial sequence
  Synthetic oligonucleotide
cgatccccagctgatg

SEQ ID NO: 2458 - DNA, 16 bp, Artificial sequence
  Synthetic oligonucleotide
acatcggtgtagacgc

SEQ ID NO: 2459 - DNA, 16 bp, Artificial sequence
  Synthetic oligonucleotide
tcccggatccaggcca

SEQ ID NO: 2460 - DNA, 16 bp, Artificial sequence
  Synthetic oligonucleotide
atgagtccctgagcaa

SEQ ID NO: 2461 - DNA, 16 bp, Artificial sequence
  Synthetic oligonucleotide
ctctctcactgcggaa

SEQ ID NO: 2462 - DNA, 16 bp, Artificial sequence
  Synthetic oligonucleotide
gcgcggagctggccgc

SEQ ID NO: 2463 - DNA, 16 bp, Artificial sequence
  Synthetic oligonucleotide
ttgagttcctgcgcca

SEQ ID NO: 2464 - DNA, 16 bp, Artificial sequence
  Synthetic oligonucleotide
actcaccgaaagtgtt

SEQ ID NO: 2465 - DNA, 16 bp, Artificial sequence
  Synthetic oligonucleotide
cctagtcacctggacc

SEQ ID NO: 2466 - DNA, 16 bp, Artificial sequence
  Synthetic oligonucleotide
cctccccccgttgtct

SEQ ID NO: 2467 - DNA, 16 bp, Artificial sequence
  Synthetic oligonucleotide
gaactgactataagtc

SEQ ID NO: 2468 - DNA, 16 bp, Artificial sequence
  Synthetic oligonucleotide
gcactagactagactg

SEQ ID NO: 2469 - DNA, 16 bp, Artificial sequence
  Synthetic oligonucleotide
cacgatcactctagtg

SEQ ID NO: 2470 - DNA, 16 bp, Artificial sequence
  Synthetic oligonucleotide
gaggcattcagatgcc

SEQ ID NO: 2471 - DNA, 16 bp, Artificial sequence
  Synthetic oligonucleotide
gaatacctcacatggg

SEQ ID NO: 2472 - DNA, 16 bp, Artificial sequence
  Synthetic oligonucleotide
gggtaaggtccatctg

SEQ ID NO: 2473 - DNA, 16 bp, Artificial sequence
  Synthetic oligonucleotide
caaggatagggcacca

SEQ ID NO: 2474 - DNA, 16 bp, Artificial sequence
  Synthetic oligonucleotide
aggcaaagtgcacttg

SEQ ID NO: 2475 - DNA, 16 bp, Artificial sequence
  Synthetic oligonucleotide
gcattgatgaatcagc

SEQ ID NO: 2476 - DNA, 16 bp, Artificial sequence
  Synthetic oligonucleotide
gcacaagaaggctacc

SEQ ID NO: 2477 - DNA, 16 bp, Artificial sequence
  Synthetic oligonucleotide
aatagtacagttgatc

SEQ ID NO: 2478 - DNA, 16 bp, Artificial sequence
  Synthetic oligonucleotide
caggagtcagatagct

SEQ ID NO: 2479 - DNA, 16 bp, Artificial sequence
  Synthetic oligonucleotide
gcagggtacatgtctc

SEQ ID NO: 2480 - DNA, 16 bp, Artificial sequence
  Synthetic oligonucleotide
ttggtttacccacctg

SEQ ID NO: 2481 - DNA, 16 bp, Artificial sequence
  Synthetic oligonucleotide
atccagcaacctattc

SEQ ID NO: 2482 - DNA, 16 bp, Artificial sequence
  Synthetic oligonucleotide
atagtggtctcaggag

SEQ ID NO: 2483 - DNA, 16 bp, Artificial sequence
  Synthetic oligonucleotide
ctgggcctaaagaccc

SEQ ID NO: 2484 - DNA, 16 bp, Artificial sequence
  Synthetic oligonucleotide
ggcgcaccggcagaag

SEQ ID NO: 2485 - DNA, 16 bp, Artificial sequence
  Synthetic oligonucleotide
ctagctcgcccggcgc

SEQ ID NO: 2486 - DNA, 16 bp, Artificial sequence
  Synthetic oligonucleotide
ggacggagagcccgcg

SEQ ID NO: 2487 - DNA, 16 bp, Artificial sequence
  Synthetic oligonucleotide
gagacggaggagccgc

SEQ ID NO: 2488 - DNA, 16 bp, Artificial sequence
  Synthetic oligonucleotide
accccaatcccgtgtt

SEQ ID NO: 2489 - DNA, 16 bp, Artificial sequence
  Synthetic oligonucleotide
acagagctaacccggg

SEQ ID NO: 2490 - DNA, 16 bp, Artificial sequence
  Synthetic oligonucleotide
tgcccctagcagttgt

SEQ ID NO: 2491 - DNA, 16 bp, Artificial sequence
  Synthetic oligonucleotide
accaaagtcgcgggct

SEQ ID NO: 2492 - DNA, 16 bp, Artificial sequence
  Synthetic oligonucleotide
cattctgtaggcaccc

SEQ ID NO: 2493 - DNA, 16 bp, Artificial sequence
  Synthetic oligonucleotide
aagagcaagttcgatt

SEQ ID NO: 2494 - DNA, 16 bp, Artificial sequence
  Synthetic oligonucleotide
agtcgcagaacctggc

SEQ ID NO: 2495 - DNA, 16 bp, Artificial sequence
  Synthetic oligonucleotide
gatttgaatgggcgga

SEQ ID NO: 2496 - DNA, 16 bp, Artificial sequence
  Synthetic oligonucleotide
cggacgatggacaaag

SEQ ID NO: 2497 - DNA, 16 bp, Artificial sequence
  Synthetic oligonucleotide
tattcctccgcccctg

SEQ ID NO: 2498 - DNA, 16 bp, Artificial sequence
  Synthetic oligonucleotide
cgctgtggacctgaga

SEQ ID NO: 2499 - DNA, 16 bp, Artificial sequence
  Synthetic oligonucleotide
caggagtccagatcaa

SEQ ID NO: 2500 - DNA, 16 bp, Artificial sequence
  Synthetic oligonucleotide
gactccaagctcacca

SEQ ID NO: 2501 - DNA, 16 bp, Artificial sequence
  Synthetic oligonucleotide
tacttatgctccttgg

SEQ ID NO: 2502 - DNA, 16 bp, Artificial sequence
  Synthetic oligonucleotide
agtgagaacgactgtg

SEQ ID NO: 2503 - DNA, 16 bp, Artificial sequence
  Synthetic oligonucleotide
tgccggtggtactgga

SEQ ID NO: 2504 - DNA, 16 bp, Artificial sequence
  Synthetic oligonucleotide
gccggcccttgtgggt

SEQ ID NO: 2505 - DNA, 16 bp, Artificial sequence
  Synthetic oligonucleotide
gtatccccatcgctgg

SEQ ID NO: 2506 - DNA, 16 bp, Artificial sequence
  Synthetic oligonucleotide
gtgaggtgttgtggac

SEQ ID NO: 2507 - DNA, 16 bp, Artificial sequence
  Synthetic oligonucleotide
ccatatctcattcttg

SEQ ID NO: 2508 - DNA, 16 bp, Artificial sequence
  Synthetic oligonucleotide
gccgctggcagtgggc

SEQ ID NO: 2509 - DNA, 16 bp, Artificial sequence
  Synthetic oligonucleotide
agcgacccccatggag

SEQ ID NO: 2510 - DNA, 16 bp, Artificial sequence
  Synthetic oligonucleotide
accgggcagtggcaca

SEQ ID NO: 2511 - DNA, 16 bp, Artificial sequence
  Synthetic oligonucleotide
cgtcgcagaaggctcc

SEQ ID NO: 2512 - DNA, 16 bp, Artificial sequence
  Synthetic oligonucleotide
ccgcggtagctgagcc

SEQ ID NO: 2513 - DNA, 16 bp, Artificial sequence
  Synthetic oligonucleotide
aggcccacggctgaca

SEQ ID NO: 2514 - DNA, 16 bp, Artificial sequence
  Synthetic oligonucleotide
ccagttccgcgcttgc

SEQ ID NO: 2515 - DNA, 16 bp, Artificial sequence
  Synthetic oligonucleotide
caccacgggcggatgt

SEQ ID NO: 2516 - DNA, 16 bp, Artificial sequence
  Synthetic oligonucleotide
cccagctcagccggtc

SEQ ID NO: 2517 - DNA, 16 bp, Artificial sequence
  Synthetic oligonucleotide
gcgcgggcatgagtgg

SEQ ID NO: 2518 - DNA, 16 bp, Artificial sequence
  Synthetic oligonucleotide
gtctgggactgaggcg

SEQ ID NO: 2519 - DNA, 16 bp, Artificial sequence
  Synthetic oligonucleotide
ggtcagggaaggcggc

SEQ ID NO: 2520 - DNA, 16 bp, Artificial sequence
  Synthetic oligonucleotide
tcttgcggagccgctg

SEQ ID NO: 2521 - DNA, 16 bp, Artificial sequence
  Synthetic oligonucleotide
gacgcgggtcatcgaa

SEQ ID NO: 2522 - DNA, 16 bp, Artificial sequence
  Synthetic oligonucleotide
ccagtacagcgcggcg

SEQ ID NO: 2523 - DNA, 16 bp, Artificial sequence
  Synthetic oligonucleotide
cgatgaggctgccggc

SEQ ID NO: 2524 - DNA, 16 bp, Artificial sequence
  Synthetic oligonucleotide
tggccgagcaccaccg

SEQ ID NO: 2525 - DNA, 16 bp, Artificial sequence
  Synthetic oligonucleotide
cgtgcaagcggtagga

SEQ ID NO: 2526 - DNA, 16 bp, Artificial sequence
  Synthetic oligonucleotide
cctgaaggcgcaacag

SEQ ID NO: 2527 - DNA, 16 bp, Artificial sequence
  Synthetic oligonucleotide
agcgcgcagctgccgt

SEQ ID NO: 2528 - DNA, 16 bp, Artificial sequence
  Synthetic oligonucleotide
tggcaggcacaccggc

SEQ ID NO: 2529 - DNA, 16 bp, Artificial sequence
  Synthetic oligonucleotide
actggtggccccagcc

SEQ ID NO: 2530 - DNA, 16 bp, Artificial sequence
  Synthetic oligonucleotide
gcatattcctccgccc

SEQ ID NO: 2531 - DNA, 16 bp, Artificial sequence
  Synthetic oligonucleotide
agggagaggaacggta

SEQ ID NO: 2532 - DNA, 16 bp, Artificial sequence
  Synthetic oligonucleotide
cctcgaggaaccctgc

SEQ ID NO: 2533 - DNA, 16 bp, Artificial sequence
  Synthetic oligonucleotide
tggtcctcacacacca

SEQ ID NO: 2534 - DNA, 16 bp, Artificial sequence
  Synthetic oligonucleotide
cccgatccccagctga

SEQ ID NO: 2535 - DNA, 16 bp, Artificial sequence
  Synthetic oligonucleotide
cacatcggtgtagacg

SEQ ID NO: 2536 - DNA, 16 bp, Artificial sequence
  Synthetic oligonucleotide
ctcccggatccaggcc

SEQ ID NO: 2537 - DNA, 16 bp, Artificial sequence
  Synthetic oligonucleotide
gatgagtccctgagca

SEQ ID NO: 2538 - DNA, 16 bp, Artificial sequence
  Synthetic oligonucleotide
tccatgccccagccac

SEQ ID NO: 2539 - DNA, 16 bp, Artificial sequence
  Synthetic oligonucleotide
ggcgcggagctggccg

SEQ ID NO: 2540 - DNA, 16 bp, Artificial sequence
  Synthetic oligonucleotide
attgagttcctgcgcc

SEQ ID NO: 2541 - DNA, 16 bp, Artificial sequence
  Synthetic oligonucleotide
gcactcaccgaaagtg

SEQ ID NO: 2542 - DNA, 16 bp, Artificial sequence
  Synthetic oligonucleotide
tcctagtcacctggac

SEQ ID NO: 2543 - DNA, 16 bp, Artificial sequence
  Synthetic oligonucleotide
acctccccccgttgtc

SEQ ID NO: 2544 - DNA, 16 bp, Artificial sequence
  Synthetic oligonucleotide
ggaactgactataagt

SEQ ID NO: 2545 - DNA, 16 bp, Artificial sequence
  Synthetic oligonucleotide
ggcactagactagact

SEQ ID NO: 2546 - DNA, 16 bp, Artificial sequence
  Synthetic oligonucleotide
tcacgatcactctagt

SEQ ID NO: 2547 - DNA, 16 bp, Artificial sequence
  Synthetic oligonucleotide
ctcgcccagagtcacc

SEQ ID NO: 2548 - DNA, 16 bp, Artificial sequence
  Synthetic oligonucleotide
tgaatacctcacatgg

SEQ ID NO: 2549 - DNA, 16 bp, Artificial sequence
  Synthetic oligonucleotide
agggtaaggtccatct

SEQ ID NO: 2550 - DNA, 16 bp, Artificial sequence
  Synthetic oligonucleotide
gcaaggatagggcacc

SEQ ID NO: 2551 - DNA, 16 bp, Artificial sequence
  Synthetic oligonucleotide
ttcagaggaattgtcg

SEQ ID NO: 2552 - DNA, 16 bp, Artificial sequence
  Synthetic oligonucleotide
tagcattgatgaatca

SEQ ID NO: 2553 - DNA, 16 bp, Artificial sequence
  Synthetic oligonucleotide
gtgtagttcctaagca

SEQ ID NO: 2554 - DNA, 16 bp, Artificial sequence
  Synthetic oligonucleotide
cggcagtaataatagt

SEQ ID NO: 2555 - DNA, 16 bp, Artificial sequence
  Synthetic oligonucleotide
tctaaaagttgggttc

SEQ ID NO: 2556 - DNA, 16 bp, Artificial sequence
  Synthetic oligonucleotide
gccctatcacagtccc

SEQ ID NO: 2557 - DNA, 16 bp, Artificial sequence
  Synthetic oligonucleotide
gcttggtttacccacc

SEQ ID NO: 2558 - DNA, 16 bp, Artificial sequence
  Synthetic oligonucleotide
gtatccagcaacctat

SEQ ID NO: 2559 - DNA, 16 bp, Artificial sequence
  Synthetic oligonucleotide
gatagtggtctcagga

SEQ ID NO: 2560 - DNA, 16 bp, Artificial sequence
  Synthetic oligonucleotide
cctgggcctaaagacc

SEQ ID NO: 2561 - DNA, 16 bp, Artificial sequence
  Synthetic oligonucleotide
cggcgcaccggcagaa

SEQ ID NO: 2562 - DNA, 16 bp, Artificial sequence
  Synthetic oligonucleotide
tctagctcgcccggcg

SEQ ID NO: 2563 - DNA, 16 bp, Artificial sequence
  Synthetic oligonucleotide
aggacggagagcccgc

SEQ ID NO: 2564 - DNA, 16 bp, Artificial sequence
  Synthetic oligonucleotide
gcgctgggagacggag

SEQ ID NO: 2565 - DNA, 16 bp, Artificial sequence
  Synthetic oligonucleotide
aaccccaatcccgtgt

SEQ ID NO: 2566 - DNA, 16 bp, Artificial sequence
  Synthetic oligonucleotide
aacagagctaacccgg

SEQ ID NO: 2567 - DNA, 16 bp, Artificial sequence
  Synthetic oligonucleotide
ctgcccctagcagttg

SEQ ID NO: 2568 - DNA, 16 bp, Artificial sequence
  Synthetic oligonucleotide
taccaaagtcgcgggc

SEQ ID NO: 2569 - DNA, 16 bp, Artificial sequence
  Synthetic oligonucleotide
cgccacccattctgta

SEQ ID NO: 2570 - DNA, 16 bp, Artificial sequence
  Synthetic oligonucleotide
caagagcaagttcgat

SEQ ID NO: 2571 - DNA, 16 bp, Artificial sequence
  Synthetic oligonucleotide
agagtcgcagaacctg

SEQ ID NO: 2572 - DNA, 16 bp, Artificial sequence
  Synthetic oligonucleotide
ggatttgaatgggcgg

SEQ ID NO: 2573 - DNA, 16 bp, Artificial sequence
  Synthetic oligonucleotide
ccggacgatggacaaa

SEQ ID NO: 2574 - DNA, 16 bp, Artificial sequence
  Synthetic oligonucleotide
atattcctccgcccct

SEQ ID NO: 2575 - DNA, 16 bp, Artificial sequence
  Synthetic oligonucleotide
acacgcagctcagcgc

SEQ ID NO: 2576 - DNA, 16 bp, Artificial sequence
  Synthetic oligonucleotide
tccaggagtccagatc

SEQ ID NO: 2577 - DNA, 16 bp, Artificial sequence
  Synthetic oligonucleotide
tgactccaagctcacc

SEQ ID NO: 2578 - DNA, 16 bp, Artificial sequence
  Synthetic oligonucleotide
gtacttatgctccttg

SEQ ID NO: 2579 - DNA, 16 bp, Artificial sequence
  Synthetic oligonucleotide
cagtgagaacgactgt

SEQ ID NO: 2580 - DNA, 16 bp, Artificial sequence
  Synthetic oligonucleotide
ctgccggtggtactgg

SEQ ID NO: 2581 - DNA, 16 bp, Artificial sequence
  Synthetic oligonucleotide
tggccggcccttgtgg

SEQ ID NO: 2582 - DNA, 16 bp, Artificial sequence
  Synthetic oligonucleotide
cagtatccccatcgct

SEQ ID NO: 2583 - DNA, 16 bp, Artificial sequence
  Synthetic oligonucleotide
agtgaggtgttgtgga

SEQ ID NO: 2584 - DNA, 16 bp, Artificial sequence
  Synthetic oligonucleotide
ataccatatctcattc

SEQ ID NO: 2585 - DNA, 16 bp, Artificial sequence
  Synthetic oligonucleotide
agccgctggcagtggg

SEQ ID NO: 2586 - DNA, 16 bp, Artificial sequence
  Synthetic oligonucleotide
cagcgacccccatgga

SEQ ID NO: 2587 - DNA, 16 bp, Artificial sequence
  Synthetic oligonucleotide
caccgggcagtggcac

SEQ ID NO: 2588 - DNA, 16 bp, Artificial sequence
  Synthetic oligonucleotide
tgccttggtgtccacg

SEQ ID NO: 2589 - DNA, 16 bp, Artificial sequence
  Synthetic oligonucleotide
gccgcggtagctgagc

SEQ ID NO: 2590 - DNA, 16 bp, Artificial sequence
  Synthetic oligonucleotide
gaggcccacggctgac

SEQ ID NO: 2591 - DNA, 16 bp, Artificial sequence
  Synthetic oligonucleotide
cccagttccgcgcttg

SEQ ID NO: 2592 - DNA, 16 bp, Artificial sequence
  Synthetic oligonucleotide
agcaccacgggcggat

SEQ ID NO: 2593 - DNA, 16 bp, Artificial sequence
  Synthetic oligonucleotide
tcccagctcagccggt

SEQ ID NO: 2594 - DNA, 16 bp, Artificial sequence
  Synthetic oligonucleotide
tgcgcgggcatgagtg

SEQ ID NO: 2595 - DNA, 16 bp, Artificial sequence
  Synthetic oligonucleotide
cggcaaggctcccggg

SEQ ID NO: 2596 - DNA, 16 bp, Artificial sequence
  Synthetic oligonucleotide
gccgttcctggtcagg

SEQ ID NO: 2597 - DNA, 16 bp, Artificial sequence
  Synthetic oligonucleotide
ctcttgcggagccgct

SEQ ID NO: 2598 - DNA, 16 bp, Artificial sequence
  Synthetic oligonucleotide
cgacgcgggtcatcga

SEQ ID NO: 2599 - DNA, 16 bp, Artificial sequence
  Synthetic oligonucleotide
cccagtacagcgcggc

SEQ ID NO: 2600 - DNA, 16 bp, Artificial sequence
  Synthetic oligonucleotide
gcgatgaggctgccgg

SEQ ID NO: 2601 - DNA, 16 bp, Artificial sequence
  Synthetic oligonucleotide
ctggccgagcaccacc

SEQ ID NO: 2602 - DNA, 16 bp, Artificial sequence
  Synthetic oligonucleotide
gggcgagaaggcctcg

SEQ ID NO: 2603 - DNA, 16 bp, Artificial sequence
  Synthetic oligonucleotide
tcctgaaggcgcaaca

SEQ ID NO: 2604 - DNA, 16 bp, Artificial sequence
  Synthetic oligonucleotide
gagcgcgcagctgccg

SEQ ID NO: 2605 - DNA, 16 bp, Artificial sequence
  Synthetic oligonucleotide
ttggcaggcacaccgg

SEQ ID NO: 2606 - DNA, 16 bp, Artificial sequence
  Synthetic oligonucleotide
aactggtggccccagc

SEQ ID NO: 2607 - DNA, 16 bp, Artificial sequence
  Synthetic oligonucleotide
ggcatattcctccgcc

SEQ ID NO: 2608 - DNA, 16 bp, Artificial sequence
  Synthetic oligonucleotide
cagggagaggaacggt

SEQ ID NO: 2609 - DNA, 16 bp, Artificial sequence
  Synthetic oligonucleotide
ccctcgaggaaccctg

SEQ ID NO: 2610 - DNA, 16 bp, Artificial sequence
  Synthetic oligonucleotide
ttggtcctcacacacc

SEQ ID NO: 2611 - DNA, 16 bp, Artificial sequence
  Synthetic oligonucleotide
gcccgatccccagctg

SEQ ID NO: 2612 - DNA, 16 bp, Artificial sequence
  Synthetic oligonucleotide
ccacatcggtgtagac

SEQ ID NO: 2613 - DNA, 16 bp, Artificial sequence
  Synthetic oligonucleotide
gctcccggatccaggc

SEQ ID NO: 2614 - DNA, 16 bp, Artificial sequence
  Synthetic oligonucleotide
agatgagtccctgagc

SEQ ID NO: 2615 - DNA, 16 bp, Artificial sequence
  Synthetic oligonucleotide
ttccatgccccagcca

SEQ ID NO: 2616 - DNA, 16 bp, Artificial sequence
  Synthetic oligonucleotide
tggcgcggagctggcc

SEQ ID NO: 2617 - DNA, 16 bp, Artificial sequence
  Synthetic oligonucleotide
tattgagttcctgcgc

SEQ ID NO: 2618 - DNA, 16 bp, Artificial sequence
  Synthetic oligonucleotide
agcactcaccgaaagt

SEQ ID NO: 2619 - DNA, 16 bp, Artificial sequence
  Synthetic oligonucleotide
ctcctagtcacctgga

SEQ ID NO: 2620 - DNA, 16 bp, Artificial sequence
  Synthetic oligonucleotide
tctacctccccccgtt

SEQ ID NO: 2621 - DNA, 16 bp, Artificial sequence
  Synthetic oligonucleotide
gggaactgactataag

SEQ ID NO: 2622 - DNA, 16 bp, Artificial sequence
  Synthetic oligonucleotide
aggcactagactagac

SEQ ID NO: 2623 - DNA, 16 bp, Artificial sequence
  Synthetic oligonucleotide
ctcacgatcactctag

SEQ ID NO: 2624 - DNA, 16 bp, Artificial sequence
  Synthetic oligonucleotide
ccctcgcccagagtca

SEQ ID NO: 2625 - DNA, 16 bp, Artificial sequence
  Synthetic oligonucleotide
ggctgaatacctcaca

SEQ ID NO: 2626 - DNA, 16 bp, Artificial sequence
  Synthetic oligonucleotide
cagggtaaggtccatc

SEQ ID NO: 2627 - DNA, 16 bp, Artificial sequence
  Synthetic oligonucleotide
ggcaaggatagggcac

SEQ ID NO: 2628 - DNA, 16 bp, Artificial sequence
  Synthetic oligonucleotide
cgcgaataatgagaat

SEQ ID NO: 2629 - DNA, 16 bp, Artificial sequence
  Synthetic oligonucleotide
cagcttagcattgatg

SEQ ID NO: 2630 - DNA, 16 bp, Artificial sequence
  Synthetic oligonucleotide
gctgtgtagttcctaa

SEQ ID NO: 2631 - DNA, 16 bp, Artificial sequence
  Synthetic oligonucleotide
acggcagtaataatag

SEQ ID NO: 2632 - DNA, 16 bp, Artificial sequence
  Synthetic oligonucleotide
gctctaaaagttgggt

SEQ ID NO: 2633 - DNA, 16 bp, Artificial sequence
  Synthetic oligonucleotide
tagcacacctgtagaa

SEQ ID NO: 2634 - DNA, 16 bp, Artificial sequence
  Synthetic oligonucleotide
agcttggtttacccac

SEQ ID NO: 2635 - DNA, 16 bp, Artificial sequence
  Synthetic oligonucleotide
gagtatccagcaacct

SEQ ID NO: 2636 - DNA, 16 bp, Artificial sequence
  Synthetic oligonucleotide
ggatagtggtctcagg

SEQ ID NO: 2637 - DNA, 16 bp, Artificial sequence
  Synthetic oligonucleotide
cccctgggcctaaaga

SEQ ID NO: 2638 - DNA, 16 bp, Artificial sequence
  Synthetic oligonucleotide
gcggcgcaccggcaga

SEQ ID NO: 2639 - DNA, 16 bp, Artificial sequence
  Synthetic oligonucleotide
atctagctcgcccggc

SEQ ID NO: 2640 - DNA, 16 bp, Artificial sequence
  Synthetic oligonucleotide
gaggacggagagcccg

SEQ ID NO: 2641 - DNA, 16 bp, Artificial sequence
  Synthetic oligonucleotide
tgcgctgggagacgga

SEQ ID NO: 2642 - DNA, 16 bp, Artificial sequence
  Synthetic oligonucleotide
gaaccccaatcccgtg

SEQ ID NO: 2643 - DNA, 16 bp, Artificial sequence
  Synthetic oligonucleotide
caacagagctaacccg

SEQ ID NO: 2644 - DNA, 16 bp, Artificial sequence
  Synthetic oligonucleotide
gatcaaaggtctcctc

SEQ ID NO: 2645 - DNA, 16 bp, Artificial sequence
  Synthetic oligonucleotide
ataccaaagtcgcggg

SEQ ID NO: 2646 - DNA, 16 bp, Artificial sequence
  Synthetic oligonucleotide
acccatcaggtcagcg

SEQ ID NO: 2647 - DNA, 16 bp, Artificial sequence
  Synthetic oligonucleotide
ccaagagcaagttcga

SEQ ID NO: 2648 - DNA, 16 bp, Artificial sequence
  Synthetic oligonucleotide
cagagtcgcagaacct

SEQ ID NO: 2649 - DNA, 16 bp, Artificial sequence
  Synthetic oligonucleotide
aggatttgaatgggcg

SEQ ID NO: 2650 - DNA, 16 bp, Artificial sequence
  Synthetic oligonucleotide
cccggacgatggacaa

SEQ ID NO: 2651 - DNA, 16 bp, Artificial sequence
  Synthetic oligonucleotide
cacctggcacgcatcg

SEQ ID NO: 2652 - DNA, 16 bp, Artificial sequence
  Synthetic oligonucleotide
aaacacgcagctcagc

SEQ ID NO: 2653 - DNA, 16 bp, Artificial sequence
  Synthetic oligonucleotide
ctatccaggagtccag

SEQ ID NO: 2654 - DNA, 16 bp, Artificial sequence
  Synthetic oligonucleotide
agtgttgactccaagc

SEQ ID NO: 2655 - DNA, 16 bp, Artificial sequence
  Synthetic oligonucleotide
tgtacttatgctcctt

SEQ ID NO: 2656 - DNA, 16 bp, Artificial sequence
  Synthetic oligonucleotide
acagtgagaacgactg

SEQ ID NO: 2657 - DNA, 16 bp, Artificial sequence
  Synthetic oligonucleotide
tggtacagctgccggt

SEQ ID NO: 2658 - DNA, 16 bp, Artificial sequence
  Synthetic oligonucleotide
ctggccggcccttgtg

SEQ ID NO: 2659 - DNA, 16 bp, Artificial sequence
  Synthetic oligonucleotide
acagtatccccatcgc

SEQ ID NO: 2660 - DNA, 16 bp, Artificial sequence
  Synthetic oligonucleotide
cagtgaggtgttgtgg

SEQ ID NO: 2661 - DNA, 16 bp, Artificial sequence
  Synthetic oligonucleotide
ctataccatatctcat

SEQ ID NO: 2662 - DNA, 16 bp, Artificial sequence
  Synthetic oligonucleotide
ggccagccgctggcag

SEQ ID NO: 2663 - DNA, 16 bp, Artificial sequence
  Synthetic oligonucleotide
gcagcgacccccatgg

SEQ ID NO: 2664 - DNA, 16 bp, Artificial sequence
  Synthetic oligonucleotide
ccaccgggcagtggca

SEQ ID NO: 2665 - DNA, 16 bp, Artificial sequence
  Synthetic oligonucleotide
agcttgccttggtgtc

SEQ ID NO: 2666 - DNA, 16 bp, Artificial sequence
  Synthetic oligonucleotide
ggccgcggtagctgag

SEQ ID NO: 2667 - DNA, 16 bp, Artificial sequence
  Synthetic oligonucleotide
tccgaggcccacggct

SEQ ID NO: 2668 - DNA, 16 bp, Artificial sequence
  Synthetic oligonucleotide
ccccagttccgcgctt

SEQ ID NO: 2669 - DNA, 16 bp, Artificial sequence
  Synthetic oligonucleotide
aagcaccacgggcgga

SEQ ID NO: 2670 - DNA, 16 bp, Artificial sequence
  Synthetic oligonucleotide
cgcagtactcccagct

SEQ ID NO: 2671 - DNA, 16 bp, Artificial sequence
  Synthetic oligonucleotide
ctgcgcgggcatgagt

SEQ ID NO: 2672 - DNA, 16 bp, Artificial sequence
  Synthetic oligonucleotide
ccggcaaggctcccgg

SEQ ID NO: 2673 - DNA, 16 bp, Artificial sequence
  Synthetic oligonucleotide
tgggccgttcctggtc

SEQ ID NO: 2674 - DNA, 16 bp, Artificial sequence
  Synthetic oligonucleotide
actcttgcggagccgc

SEQ ID NO: 2675 - DNA, 16 bp, Artificial sequence
  Synthetic oligonucleotide
aacgacgcgggtcatc

SEQ ID NO: 2676 - DNA, 16 bp, Artificial sequence
  Synthetic oligonucleotide
ccccagtacagcgcgg

SEQ ID NO: 2677 - DNA, 16 bp, Artificial sequence
  Synthetic oligonucleotide
ggcgatgaggctgccg

SEQ ID NO: 2678 - DNA, 16 bp, Artificial sequence
  Synthetic oligonucleotide
tcctggccgagcacca

SEQ ID NO: 2679 - DNA, 16 bp, Artificial sequence
  Synthetic oligonucleotide
cgggcgagaaggcctc

SEQ ID NO: 2680 - DNA, 16 bp, Artificial sequence
  Synthetic oligonucleotide
ctcctgaaggcgcaac

SEQ ID NO: 2681 - DNA, 16 bp, Artificial sequence
  Synthetic oligonucleotide
aggagcgcgcagctgc

SEQ ID NO: 2682 - DNA, 16 bp, Artificial sequence
  Synthetic oligonucleotide
cgcttggcaggcacac

SEQ ID NO: 2683 - DNA, 16 bp, Artificial sequence
  Synthetic oligonucleotide
gaactggtggccccag

SEQ ID NO: 2684 - DNA, 16 bp, Artificial sequence
  Synthetic oligonucleotide
tggcatattcctccgc

SEQ ID NO: 2685 - DNA, 16 bp, Artificial sequence
  Synthetic oligonucleotide
ggaggatccgtgcacg

SEQ ID NO: 2686 - DNA, 16 bp, Artificial sequence
  Synthetic oligonucleotide
gccctcgaggaaccct

SEQ ID NO: 2687 - DNA, 16 bp, Artificial sequence
  Synthetic oligonucleotide
cttggtcctcacacac

SEQ ID NO: 2688 - DNA, 16 bp, Artificial sequence
  Synthetic oligonucleotide
agcccgatccccagct

SEQ ID NO: 2689 - DNA, 16 bp, Artificial sequence
  Synthetic oligonucleotide
gccacatcggtgtaga

SEQ ID NO: 2690 - DNA, 16 bp, Artificial sequence
  Synthetic oligonucleotide
aacggtgtgctcccgg

SEQ ID NO: 2691 - DNA, 16 bp, Artificial sequence
  Synthetic oligonucleotide
aagatgagtccctgag

SEQ ID NO: 2692 - DNA, 16 bp, Artificial sequence
  Synthetic oligonucleotide
cttccatgccccagcc

SEQ ID NO: 2693 - DNA, 16 bp, Artificial sequence
  Synthetic oligonucleotide
ctggcgcggagctggc

SEQ ID NO: 2694 - DNA, 16 bp, Artificial sequence
  Synthetic oligonucleotide
ttattgagttcctgcg

SEQ ID NO: 2695 - DNA, 16 bp, Artificial sequence
  Synthetic oligonucleotide
cagcactcaccgaaag

SEQ ID NO: 2696 - DNA, 16 bp, Artificial sequence
  Synthetic oligonucleotide
taggcctcctagtcac

SEQ ID NO: 2697 - DNA, 16 bp, Artificial sequence
  Synthetic oligonucleotide
ttctacctccccccgt

SEQ ID NO: 2698 - DNA, 16 bp, Artificial sequence
  Synthetic oligonucleotide
gcagggaactgactat

SEQ ID NO: 2699 - DNA, 16 bp, Artificial sequence
  Synthetic oligonucleotide
gtaggcactagactag

SEQ ID NO: 2700 - DNA, 16 bp, Artificial sequence
  Synthetic oligonucleotide
gctcacgatcactcta

SEQ ID NO: 2701 - DNA, 16 bp, Artificial sequence
  Synthetic oligonucleotide
atccctcgcccagagt

SEQ ID NO: 2702 - DNA, 16 bp, Artificial sequence
  Synthetic oligonucleotide
tgggctgaatacctca

SEQ ID NO: 2703 - DNA, 16 bp, Artificial sequence
  Synthetic oligonucleotide
ccagggtaaggtccat

SEQ ID NO: 2704 - DNA, 16 bp, Artificial sequence
  Synthetic oligonucleotide
taggcaaggatagggc

SEQ ID NO: 2705 - DNA, 16 bp, Artificial sequence
  Synthetic oligonucleotide
tcgcgaataatgagaa

SEQ ID NO: 2706 - DNA, 16 bp, Artificial sequence
  Synthetic oligonucleotide
atcagcttagcattga

SEQ ID NO: 2707 - DNA, 16 bp, Artificial sequence
  Synthetic oligonucleotide
tctacttagtgcaacg

SEQ ID NO: 2708 - DNA, 16 bp, Artificial sequence
  Synthetic oligonucleotide
tcactgttaaccactc

SEQ ID NO: 2709 - DNA, 16 bp, Artificial sequence
  Synthetic oligonucleotide
tgctctaaaagttggg

SEQ ID NO: 2710 - DNA, 16 bp, Artificial sequence
  Synthetic oligonucleotide
gggtggtagcacacct

SEQ ID NO: 2711 - DNA, 16 bp, Artificial sequence
  Synthetic oligonucleotide
aagcttggtttaccca

SEQ ID NO: 2712 - DNA, 16 bp, Artificial sequence
  Synthetic oligonucleotide
cgagtatccagcaacc

SEQ ID NO: 2713 - DNA, 16 bp, Artificial sequence
  Synthetic oligonucleotide
gggatagtggtctcag

SEQ ID NO: 2714 - DNA, 16 bp, Artificial sequence
  Synthetic oligonucleotide
cacccctgggcctaaa

SEQ ID NO: 2715 - DNA, 16 bp, Artificial sequence
  Synthetic oligonucleotide
cgcggcgcaccggcag

SEQ ID NO: 2716 - DNA, 16 bp, Artificial sequence
  Synthetic oligonucleotide
aatctagctcgcccgg

SEQ ID NO: 2717 - DNA, 16 bp, Artificial sequence
  Synthetic oligonucleotide
tgaggacggagagccc

SEQ ID NO: 2718 - DNA, 16 bp, Artificial sequence
  Synthetic oligonucleotide
ctgcgctgggagacgg

SEQ ID NO: 2719 - DNA, 16 bp, Artificial sequence
  Synthetic oligonucleotide
cgaaccccaatcccgt

SEQ ID NO: 2720 - DNA, 16 bp, Artificial sequence
  Synthetic oligonucleotide
cgcaacagagctaacc

SEQ ID NO: 2721 - DNA, 16 bp, Artificial sequence
  Synthetic oligonucleotide
ccagtgatcaaaggtc

SEQ ID NO: 2722 - DNA, 16 bp, Artificial sequence
  Synthetic oligonucleotide
gataccaaagtcgcgg

SEQ ID NO: 2723 - DNA, 16 bp, Artificial sequence
  Synthetic oligonucleotide
acaacccatcaggtca

SEQ ID NO: 2724 - DNA, 16 bp, Artificial sequence
  Synthetic oligonucleotide
accaagagcaagttcg

SEQ ID NO: 2725 - DNA, 16 bp, Artificial sequence
  Synthetic oligonucleotide
ccagagtcgcagaacc

SEQ ID NO: 2726 - DNA, 16 bp, Artificial sequence
  Synthetic oligonucleotide
cagcaagcccgaaggg

SEQ ID NO: 2727 - DNA, 16 bp, Artificial sequence
  Synthetic oligonucleotide
gcccggacgatggaca

SEQ ID NO: 2728 - DNA, 16 bp, Artificial sequence
  Synthetic oligonucleotide
tcacctggcacgcatc

SEQ ID NO: 2729 - DNA, 16 bp, Artificial sequence
  Synthetic oligonucleotide
gaaacacgcagctcag

SEQ ID NO: 2730 - DNA, 16 bp, Artificial sequence
  Synthetic oligonucleotide
gcctatccaggagtcc

SEQ ID NO: 2731 - DNA, 16 bp, Artificial sequence
  Synthetic oligonucleotide
aaagtgttgactccaa

SEQ ID NO: 2732 - DNA, 16 bp, Artificial sequence
  Synthetic oligonucleotide
ttgtacttatgctcct

SEQ ID NO: 2733 - DNA, 16 bp, Artificial sequence
  Synthetic oligonucleotide
gacagtgagaacgact

SEQ ID NO: 2734 - DNA, 16 bp, Artificial sequence
  Synthetic oligonucleotide
tgtggtacagctgccg

SEQ ID NO: 2735 - DNA, 16 bp, Artificial sequence
  Synthetic oligonucleotide
gcctggccggcccttg

SEQ ID NO: 2736 - DNA, 16 bp, Artificial sequence
  Synthetic oligonucleotide
aacagtatccccatcg

SEQ ID NO: 2737 - DNA, 16 bp, Artificial sequence
  Synthetic oligonucleotide
ccagtgaggtgttgtg

SEQ ID NO: 2738 - DNA, 16 bp, Artificial sequence
  Synthetic oligonucleotide
gttctataccatatct

SEQ ID NO: 2739 - DNA, 16 bp, Artificial sequence
  Synthetic oligonucleotide
tgcggcaggcctggct

SEQ ID NO: 2740 - DNA, 16 bp, Artificial sequence
  Synthetic oligonucleotide
ggcagcgacccccatg

SEQ ID NO: 2741 - DNA, 16 bp, Artificial sequence
  Synthetic oligonucleotide
cccaccgggcagtggc

SEQ ID NO: 2742 - DNA, 16 bp, Artificial sequence
  Synthetic oligonucleotide
agcagcttgccttggt

SEQ ID NO: 2743 - DNA, 16 bp, Artificial sequence
  Synthetic oligonucleotide
caggccgcggtagctg

SEQ ID NO: 2744 - DNA, 16 bp, Artificial sequence
  Synthetic oligonucleotide
ctccgaggcccacggc

SEQ ID NO: 2745 - DNA, 16 bp, Artificial sequence
  Synthetic oligonucleotide
tccccagttccgcgct

SEQ ID NO: 2746 - DNA, 16 bp, Artificial sequence
  Synthetic oligonucleotide
cgaagcaccacgggcg

SEQ ID NO: 2747 - DNA, 16 bp, Artificial sequence
  Synthetic oligonucleotide
tcgcagtactcccagc

SEQ ID NO: 2748 - DNA, 16 bp, Artificial sequence
  Synthetic oligonucleotide
ggctgcgcgggcatga

SEQ ID NO: 2749 - DNA, 16 bp, Artificial sequence
  Synthetic oligonucleotide
gccggcaaggctcccg

SEQ ID NO: 2750 - DNA, 16 bp, Artificial sequence
  Synthetic oligonucleotide
agtgggccgttcctgg

SEQ ID NO: 2751 - DNA, 16 bp, Artificial sequence
  Synthetic oligonucleotide
gactcttgcggagccg

SEQ ID NO: 2752 - DNA, 16 bp, Artificial sequence
  Synthetic oligonucleotide
caacgacgcgggtcat

SEQ ID NO: 2753 - DNA, 16 bp, Artificial sequence
  Synthetic oligonucleotide
tggccccagtacagcg

SEQ ID NO: 2754 - DNA, 16 bp, Artificial sequence
  Synthetic oligonucleotide
gggcgatgaggctgcc

SEQ ID NO: 2755 - DNA, 16 bp, Artificial sequence
  Synthetic oligonucleotide
acggctcacagctgtg

SEQ ID NO: 2756 - DNA, 16 bp, Artificial sequence
  Synthetic oligonucleotide
acgggcgagaaggcct

SEQ ID NO: 2757 - DNA, 16 bp, Artificial sequence
  Synthetic oligonucleotide
cctcctgaaggcgcaa

SEQ ID NO: 2758 - DNA, 16 bp, Artificial sequence
  Synthetic oligonucleotide
caggagcgcgcagctg

SEQ ID NO: 2759 - DNA, 16 bp, Artificial sequence
  Synthetic oligonucleotide
ccgcttggcaggcaca

SEQ ID NO: 2760 - DNA, 16 bp, Artificial sequence
  Synthetic oligonucleotide
cgaactggtggcccca

SEQ ID NO: 2761 - DNA, 16 bp, Artificial sequence
  Synthetic oligonucleotide
ctggcatattcctccg

SEQ ID NO: 2762 - DNA, 16 bp, Artificial sequence
  Synthetic oligonucleotide
tggaggatccgtgcac

SEQ ID NO: 2763 - DNA, 16 bp, Artificial sequence
  Synthetic oligonucleotide
cgccctcgaggaaccc

SEQ ID NO: 2764 - DNA, 16 bp, Artificial sequence
  Synthetic oligonucleotide
gcttggtcctcacaca

SEQ ID NO: 2765 - DNA, 16 bp, Artificial sequence
  Synthetic oligonucleotide
cagcccgatccccagc

SEQ ID NO: 2766 - DNA, 16 bp, Artificial sequence
  Synthetic oligonucleotide
ggccacatcggtgtag

SEQ ID NO: 2767 - DNA, 16 bp, Artificial sequence
  Synthetic oligonucleotide
aaacggtgtgctcccg

SEQ ID NO: 2768 - DNA, 16 bp, Artificial sequence
  Synthetic oligonucleotide
aaagatgagtccctga

SEQ ID NO: 2769 - DNA, 16 bp, Artificial sequence
  Synthetic oligonucleotide
ccttccatgccccagc

SEQ ID NO: 2770 - DNA, 16 bp, Artificial sequence
  Synthetic oligonucleotide
cctggcgcggagctgg

SEQ ID NO: 2771 - DNA, 16 bp, Artificial sequence
  Synthetic oligonucleotide
ctttattgagttcctg

SEQ ID NO: 2772 - DNA, 16 bp, Artificial sequence
  Synthetic oligonucleotide
ggacaatcctggttcc

SEQ ID NO: 2773 - DNA, 16 bp, Artificial sequence
  Synthetic oligonucleotide
cataggcctcctagtc

SEQ ID NO: 2774 - DNA, 16 bp, Artificial sequence
  Synthetic oligonucleotide
tttctacctccccccg

SEQ ID NO: 2775 - DNA, 16 bp, Artificial sequence
  Synthetic oligonucleotide
ggaatctacaagggag

SEQ ID NO: 2776 - DNA, 16 bp, Artificial sequence
  Synthetic oligonucleotide
aggtaggcactagact

SEQ ID NO: 2777 - DNA, 16 bp, Artificial sequence
  Synthetic oligonucleotide
cacagctcacgatcac

SEQ ID NO: 2778 - DNA, 16 bp, Artificial sequence
  Synthetic oligonucleotide
aatccctcgcccagag

SEQ ID NO: 2779 - DNA, 16 bp, Artificial sequence
  Synthetic oligonucleotide
tcatctaaaaggtagt

SEQ ID NO: 2780 - DNA, 16 bp, Artificial sequence
  Synthetic oligonucleotide
accagggtaaggtcca

SEQ ID NO: 2781 - DNA, 16 bp, Artificial sequence
  Synthetic oligonucleotide
gattaggcaaggatag

SEQ ID NO: 2782 - DNA, 16 bp, Artificial sequence
  Synthetic oligonucleotide
atcgcgaataatgaga

SEQ ID NO: 2783 - DNA, 16 bp, Artificial sequence
  Synthetic oligonucleotide
tatagtgccatcagct

SEQ ID NO: 2784 - DNA, 16 bp, Artificial sequence
  Synthetic oligonucleotide
gtctacttagtgcaac

SEQ ID NO: 2785 - DNA, 16 bp, Artificial sequence
  Synthetic oligonucleotide
agtcactgttaaccac

SEQ ID NO: 2786 - DNA, 16 bp, Artificial sequence
  Synthetic oligonucleotide
gtcgctgtgcattgaa

SEQ ID NO: 2787 - DNA, 16 bp, Artificial sequence
  Synthetic oligonucleotide
gtaatgaggcgggagg

SEQ ID NO: 2788 - DNA, 16 bp, Artificial sequence
  Synthetic oligonucleotide
gctactccaagtttcc

SEQ ID NO: 2789 - DNA, 16 bp, Artificial sequence
  Synthetic oligonucleotide
ccgagtatccagcaac

SEQ ID NO: 2790 - DNA, 16 bp, Artificial sequence
  Synthetic oligonucleotide
gagggatagtggtctc

SEQ ID NO: 2791 - DNA, 16 bp, Artificial sequence
  Synthetic oligonucleotide
cgcagtgagccacccc

SEQ ID NO: 2792 - DNA, 16 bp, Artificial sequence
  Synthetic oligonucleotide
acgcggcgcaccggca

SEQ ID NO: 2793 - DNA, 16 bp, Artificial sequence
  Synthetic oligonucleotide
gaatctagctcgcccg

SEQ ID NO: 2794 - DNA, 16 bp, Artificial sequence
  Synthetic oligonucleotide
cgccggcaaggctgtg

SEQ ID NO: 2795 - DNA, 16 bp, Artificial sequence
  Synthetic oligonucleotide
agctgcgctgggagac

SEQ ID NO: 2796 - DNA, 16 bp, Artificial sequence
  Synthetic oligonucleotide
ccgaaccccaatcccg

SEQ ID NO: 2797 - DNA, 16 bp, Artificial sequence
  Synthetic oligonucleotide
gcgcaacagagctaac

SEQ ID NO: 2798 - DNA, 16 bp, Artificial sequence
  Synthetic oligonucleotide
gcctaacccagtgatc

SEQ ID NO: 2799 - DNA, 16 bp, Artificial sequence
  Synthetic oligonucleotide
cgataccaaagtcgcg

SEQ ID NO: 2800 - DNA, 16 bp, Artificial sequence
  Synthetic oligonucleotide
cacaacccatcaggtc

SEQ ID NO: 2801 - DNA, 16 bp, Artificial sequence
  Synthetic oligonucleotide
cctttgcagcccggcg

SEQ ID NO: 2802 - DNA, 16 bp, Artificial sequence
  Synthetic oligonucleotide
tccagagtcgcagaac

SEQ ID NO: 2803 - DNA, 16 bp, Artificial sequence
  Synthetic oligonucleotide
gcagcaagcccgaagg

SEQ ID NO: 2804 - DNA, 16 bp, Artificial sequence
  Synthetic oligonucleotide
cgcccggacgatggac

SEQ ID NO: 2805 - DNA, 16 bp, Artificial sequence
  Synthetic oligonucleotide
ctcacctggcacgcat

SEQ ID NO: 2806 - DNA, 16 bp, Artificial sequence
  Synthetic oligonucleotide
ggaaacacgcagctca

SEQ ID NO: 2807 - DNA, 16 bp, Artificial sequence
  Synthetic oligonucleotide
tgcctatccaggagtc

SEQ ID NO: 2808 - DNA, 16 bp, Artificial sequence
  Synthetic oligonucleotide
gaaagtgttgactcca

SEQ ID NO: 2809 - DNA, 16 bp, Artificial sequence
  Synthetic oligonucleotide
ctttgtacttatgctc

SEQ ID NO: 2810 - DNA, 16 bp, Artificial sequence
  Synthetic oligonucleotide
tgacagtgagaacgac

SEQ ID NO: 2811 - DNA, 16 bp, Artificial sequence
  Synthetic oligonucleotide
ttgtggtacagctgcc

SEQ ID NO: 2812 - DNA, 16 bp, Artificial sequence
  Synthetic oligonucleotide
tgagggcctggccggc

SEQ ID NO: 2813 - DNA, 16 bp, Artificial sequence
  Synthetic oligonucleotide
aaacagtatccccatc

SEQ ID NO: 2814 - DNA, 16 bp, Artificial sequence
  Synthetic oligonucleotide
tccagtgaggtgttgt

SEQ ID NO: 2815 - DNA, 16 bp, Artificial sequence
  Synthetic oligonucleotide
agttctataccatatc

SEQ ID NO: 2816 - DNA, 16 bp, Artificial sequence
  Synthetic oligonucleotide
acgggttggtgcggca

SEQ ID NO: 2817 - DNA, 16 bp, Artificial sequence
  Synthetic oligonucleotide
aggcagcgacccccat

SEQ ID NO: 2818 - DNA, 16 bp, Artificial sequence
  Synthetic oligonucleotide
gcccaccgggcagtgg

SEQ ID NO: 2819 - DNA, 16 bp, Artificial sequence
  Synthetic oligonucleotide
catagcagcttgcctt

SEQ ID NO: 2820 - DNA, 16 bp, Artificial sequence
  Synthetic oligonucleotide
gccaggccgcggtagc

SEQ ID NO: 2821 - DNA, 16 bp, Artificial sequence
  Synthetic oligonucleotide
cctccgaggcccacgg

SEQ ID NO: 2822 - DNA, 16 bp, Artificial sequence
  Synthetic oligonucleotide
gtccccagttccgcgc

SEQ ID NO: 2823 - DNA, 16 bp, Artificial sequence
  Synthetic oligonucleotide
acgaagcaccacgggc

SEQ ID NO: 2824 - DNA, 16 bp, Artificial sequence
  Synthetic oligonucleotide
gtcgcagtactcccag

SEQ ID NO: 2825 - DNA, 16 bp, Artificial sequence
  Synthetic oligonucleotide
ccggctgcgcgggcat

SEQ ID NO: 2826 - DNA, 16 bp, Artificial sequence
  Synthetic oligonucleotide
cgccggcaaggctccc

SEQ ID NO: 2827 - DNA, 16 bp, Artificial sequence
  Synthetic oligonucleotide
tcagtgggccgttcct

SEQ ID NO: 2828 - DNA, 16 bp, Artificial sequence
  Synthetic oligonucleotide
agactcttgcggagcc

SEQ ID NO: 2829 - DNA, 16 bp, Artificial sequence
  Synthetic oligonucleotide
ccaacgacgcgggtca

SEQ ID NO: 2830 - DNA, 16 bp, Artificial sequence
  Synthetic oligonucleotide
aactgtggccccagta

SEQ ID NO: 2831 - DNA, 16 bp, Artificial sequence
  Synthetic oligonucleotide
cgtcagcacccagcag

SEQ ID NO: 2832 - DNA, 16 bp, Artificial sequence
  Synthetic oligonucleotide
ggcacggctcacagct

SEQ ID NO: 2833 - DNA, 16 bp, Artificial sequence
  Synthetic oligonucleotide
gacgggcgagaaggcc

SEQ ID NO: 2834 - DNA, 16 bp, Artificial sequence
  Synthetic oligonucleotide
tcctcctgaaggcgca

SEQ ID NO: 2835 - DNA, 16 bp, Artificial sequence
  Synthetic oligonucleotide
acaggagcgcgcagct

SEQ ID NO: 2836 - DNA, 16 bp, Artificial sequence
  Synthetic oligonucleotide
gccgcttggcaggcac

SEQ ID NO: 2837 - DNA, 16 bp, Artificial sequence
  Synthetic oligonucleotide
tcgaactggtggcccc

SEQ ID NO: 2838 - DNA, 16 bp, Artificial sequence
  Synthetic oligonucleotide
caggaagctggcatat

SEQ ID NO: 2839 - DNA, 16 bp, Artificial sequence
  Synthetic oligonucleotide
atggaggatccgtgca

SEQ ID NO: 2840 - DNA, 16 bp, Artificial sequence
  Synthetic oligonucleotide
ccgccctcgaggaacc

SEQ ID NO: 2841 - DNA, 16 bp, Artificial sequence
  Synthetic oligonucleotide
agcttggtcctcacac

SEQ ID NO: 2842 - DNA, 16 bp, Artificial sequence
  Synthetic oligonucleotide
ccacagcccgatcccc

SEQ ID NO: 2843 - DNA, 16 bp, Artificial sequence
  Synthetic oligonucleotide
aggccacatcggtgta

SEQ ID NO: 2844 - DNA, 16 bp, Artificial sequence
  Synthetic oligonucleotide
gaaacggtgtgctccc

SEQ ID NO: 2845 - DNA, 16 bp, Artificial sequence
  Synthetic oligonucleotide
gaaagatgagtccctg

SEQ ID NO: 2846 - DNA, 16 bp, Artificial sequence
  Synthetic oligonucleotide
gccttccatgccccag

SEQ ID NO: 2847 - DNA, 16 bp, Artificial sequence
  Synthetic oligonucleotide
tcctggcgcggagctg

SEQ ID NO: 2848 - DNA, 16 bp, Artificial sequence
  Synthetic oligonucleotide
actttattgagttcct

SEQ ID NO: 2849 - DNA, 16 bp, Artificial sequence
  Synthetic oligonucleotide
aatcctgggacaatcc

SEQ ID NO: 2850 - DNA, 16 bp, Artificial sequence
  Synthetic oligonucleotide
acataggcctcctagt

SEQ ID NO: 2851 - DNA, 16 bp, Artificial sequence
  Synthetic oligonucleotide
gatctgttgctagtct

SEQ ID NO: 2852 - DNA, 16 bp, Artificial sequence
  Synthetic oligonucleotide
ggtggaatctacaagg

SEQ ID NO: 2853 - DNA, 16 bp, Artificial sequence
  Synthetic oligonucleotide
caggtaggcactagac

SEQ ID NO: 2854 - DNA, 16 bp, Artificial sequence
  Synthetic oligonucleotide
acacagctcacgatca

SEQ ID NO: 2855 - DNA, 16 bp, Artificial sequence
  Synthetic oligonucleotide
aaatccctcgcccaga

SEQ ID NO: 2856 - DNA, 16 bp, Artificial sequence
  Synthetic oligonucleotide
gtacccttcatctaaa

SEQ ID NO: 2857 - DNA, 16 bp, Artificial sequence
  Synthetic oligonucleotide
caccagggtaaggtcc

SEQ ID NO: 2858 - DNA, 16 bp, Artificial sequence
  Synthetic oligonucleotide
ggattaggcaaggata

SEQ ID NO: 2859 - DNA, 16 bp, Artificial sequence
  Synthetic oligonucleotide
catcgcgaataatgag

SEQ ID NO: 2860 - DNA, 16 bp, Artificial sequence
  Synthetic oligonucleotide
ctatagtgccatcagc

SEQ ID NO: 2861 - DNA, 16 bp, Artificial sequence
  Synthetic oligonucleotide
cagtctacttagtgca

SEQ ID NO: 2862 - DNA, 16 bp, Artificial sequence
  Synthetic oligonucleotide
gaagagcacttgccac

SEQ ID NO: 2863 - DNA, 16 bp, Artificial sequence
  Synthetic oligonucleotide
aaggtcgctgtgcatt

SEQ ID NO: 2864 - DNA, 16 bp, Artificial sequence
  Synthetic oligonucleotide
agtaatgaggcgggag

SEQ ID NO: 2865 - DNA, 16 bp, Artificial sequence
  Synthetic oligonucleotide
ttgtgaccttgctact

SEQ ID NO: 2866 - DNA, 16 bp, Artificial sequence
  Synthetic oligonucleotide
tccgagtatccagcaa

SEQ ID NO: 2867 - DNA, 16 bp, Artificial sequence
  Synthetic oligonucleotide
agagggatagtggtct

SEQ ID NO: 2868 - DNA, 16 bp, Artificial sequence
  Synthetic oligonucleotide
acgcagtgagccaccc

SEQ ID NO: 2869 - DNA, 16 bp, Artificial sequence
  Synthetic oligonucleotide
cacgcggcgcaccggc

SEQ ID NO: 2870 - DNA, 16 bp, Artificial sequence
  Synthetic oligonucleotide
ggaatctagctcgccc

SEQ ID NO: 2871 - DNA, 16 bp, Artificial sequence
  Synthetic oligonucleotide
tcgccggcaaggctgt

SEQ ID NO: 2872 - DNA, 16 bp, Artificial sequence
  Synthetic oligonucleotide
cgtggaagctgcgctg

SEQ ID NO: 2873 - DNA, 16 bp, Artificial sequence
  Synthetic oligonucleotide
gctcccgaaccccaat

SEQ ID NO: 2874 - DNA, 16 bp, Artificial sequence
  Synthetic oligonucleotide
ggcgcaacagagctaa

SEQ ID NO: 2875 - DNA, 16 bp, Artificial sequence
  Synthetic oligonucleotide
cgcctaacccagtgat

SEQ ID NO: 2876 - DNA, 16 bp, Artificial sequence
  Synthetic oligonucleotide
acgataccaaagtcgc

SEQ ID NO: 2877 - DNA, 16 bp, Artificial sequence
  Synthetic oligonucleotide
ggattcacctacacat

SEQ ID NO: 2878 - DNA, 16 bp, Artificial sequence
  Synthetic oligonucleotide
gcctttgcagcccggc

SEQ ID NO: 2879 - DNA, 16 bp, Artificial sequence
  Synthetic oligonucleotide
atccagagtcgcagaa

SEQ ID NO: 2880 - DNA, 16 bp, Artificial sequence
  Synthetic oligonucleotide
cgcagcaagcccgaag

SEQ ID NO: 2881 - DNA, 16 bp, Artificial sequence
  Synthetic oligonucleotide
ccgcccggacgatgga

SEQ ID NO: 2882 - DNA, 16 bp, Artificial sequence
  Synthetic oligonucleotide
gctcacctggcacgca

SEQ ID NO: 2883 - DNA, 16 bp, Artificial sequence
  Synthetic oligonucleotide
cggaaacacgcagctc

SEQ ID NO: 2884 - DNA, 16 bp, Artificial sequence
  Synthetic oligonucleotide
tcgaaagtgttgactc

SEQ ID NO: 2885 - DNA, 16 bp, Artificial sequence
  Synthetic oligonucleotide
gctttgtacttatgct

SEQ ID NO: 2886 - DNA, 16 bp, Artificial sequence
  Synthetic oligonucleotide
ggtgacagtgagaacg

SEQ ID NO: 2887 - DNA, 16 bp, Artificial sequence
  Synthetic oligonucleotide
tttgtggtacagctgc

SEQ ID NO: 2888 - DNA, 16 bp, Artificial sequence
  Synthetic oligonucleotide
gctgagggcctggccg

SEQ ID NO: 2889 - DNA, 16 bp, Artificial sequence
  Synthetic oligonucleotide
caaacagtatccccat

SEQ ID NO: 2890 - DNA, 16 bp, Artificial sequence
  Synthetic oligonucleotide
gcagtggtttccagtg

SEQ ID NO: 2891 - DNA, 16 bp, Artificial sequence
  Synthetic oligonucleotide
cagttctataccatat

SEQ ID NO: 2892 - DNA, 16 bp, Artificial sequence
  Synthetic oligonucleotide
cacgggttggtgcggc

SEQ ID NO: 2893 - DNA, 16 bp, Artificial sequence
  Synthetic oligonucleotide
taggcagcgaccccca

SEQ ID NO: 2894 - DNA, 16 bp, Artificial sequence
  Synthetic oligonucleotide
tagcccaccgggcagt

SEQ ID NO: 2895 - DNA, 16 bp, Artificial sequence
  Synthetic oligonucleotide
tcatagcagcttgcct

SEQ ID NO: 2896 - DNA, 16 bp, Artificial sequence
  Synthetic oligonucleotide
ggcgcacccgagagcg

SEQ ID NO: 2897 - DNA, 16 bp, Artificial sequence
  Synthetic oligonucleotide
gcctccgaggcccacg

SEQ ID NO: 2898 - DNA, 16 bp, Artificial sequence
  Synthetic oligonucleotide
agtccccagttccgcg

SEQ ID NO: 2899 - DNA, 16 bp, Artificial sequence
  Synthetic oligonucleotide
cacgaagcaccacggg

SEQ ID NO: 2900 - DNA, 16 bp, Artificial sequence
  Synthetic oligonucleotide
ggtcgcagtactccca

SEQ ID NO: 2901 - DNA, 16 bp, Artificial sequence
  Synthetic oligonucleotide
gccggctgcgcgggca

SEQ ID NO: 2902 - DNA, 16 bp, Artificial sequence
  Synthetic oligonucleotide
tcgccggcaaggctcc

SEQ ID NO: 2903 - DNA, 16 bp, Artificial sequence
  Synthetic oligonucleotide
ctcagtgggccgttcc

SEQ ID NO: 2904 - DNA, 16 bp, Artificial sequence
  Synthetic oligonucleotide
cagactcttgcggagc

SEQ ID NO: 2905 - DNA, 16 bp, Artificial sequence
  Synthetic oligonucleotide
gccaacgacgcgggtc

SEQ ID NO: 2906 - DNA, 16 bp, Artificial sequence
  Synthetic oligonucleotide
gaaactgtggccccag

SEQ ID NO: 2907 - DNA, 16 bp, Artificial sequence
  Synthetic oligonucleotide
gccggtcctgcaggca

SEQ ID NO: 2908 - DNA, 16 bp, Artificial sequence
  Synthetic oligonucleotide
tggcacggctcacagc

SEQ ID NO: 2909 - DNA, 16 bp, Artificial sequence
  Synthetic oligonucleotide
tgacgggcgagaaggc

SEQ ID NO: 2910 - DNA, 16 bp, Artificial sequence
  Synthetic oligonucleotide
catcctcctgaaggcg

SEQ ID NO: 2911 - DNA, 16 bp, Artificial sequence
  Synthetic oligonucleotide
gacaggagcgcgcagc

SEQ ID NO: 2912 - DNA, 16 bp, Artificial sequence
  Synthetic oligonucleotide
cgccgcttggcaggca

SEQ ID NO: 2913 - DNA, 16 bp, Artificial sequence
  Synthetic oligonucleotide
ctcgaactggtggccc

SEQ ID NO: 2914 - DNA, 16 bp, Artificial sequence
  Synthetic oligonucleotide
gcaggaagctggcata

SEQ ID NO: 2915 - DNA, 16 bp, Artificial sequence
  Synthetic oligonucleotide
gatggaggatccgtgc

SEQ ID NO: 2916 - DNA, 16 bp, Artificial sequence
  Synthetic oligonucleotide
gccgccctcgaggaac

SEQ ID NO: 2917 - DNA, 16 bp, Artificial sequence
  Synthetic oligonucleotide
cagcttggtcctcaca

SEQ ID NO: 2918 - DNA, 16 bp, Artificial sequence
  Synthetic oligonucleotide
caccacagcccgatcc

SEQ ID NO: 2919 - DNA, 16 bp, Artificial sequence
  Synthetic oligonucleotide
taggccacatcggtgt

SEQ ID NO: 2920 - DNA, 16 bp, Artificial sequence
  Synthetic oligonucleotide
ggaaacggtgtgctcc

SEQ ID NO: 2921 - DNA, 16 bp, Artificial sequence
  Synthetic oligonucleotide
ggaaagatgagtccct

SEQ ID NO: 2922 - DNA, 16 bp, Artificial sequence
  Synthetic oligonucleotide
tgccttccatgcccca

SEQ ID NO: 2923 - DNA, 16 bp, Artificial sequence
  Synthetic oligonucleotide
atcctggcgcggagct

SEQ ID NO: 2924 - DNA, 16 bp, Artificial sequence
  Synthetic oligonucleotide
cactttattgagttcc

SEQ ID NO: 2925 - DNA, 16 bp, Artificial sequence
  Synthetic oligonucleotide
accccccagaacaatc

SEQ ID NO: 2926 - DNA, 16 bp, Artificial sequence
  Synthetic oligonucleotide
cacataggcctcctag

SEQ ID NO: 2927 - DNA, 16 bp, Artificial sequence
  Synthetic oligonucleotide
accgatctgttgctag

SEQ ID NO: 2928 - DNA, 16 bp, Artificial sequence
  Synthetic oligonucleotide
caaggtggaatctaca

SEQ ID NO: 2929 - DNA, 16 bp, Artificial sequence
  Synthetic oligonucleotide
ccaggtaggcactaga

SEQ ID NO: 2930 - DNA, 16 bp, Artificial sequence
  Synthetic oligonucleotide
ttagacacagcccata

SEQ ID NO: 2931 - DNA, 16 bp, Artificial sequence
  Synthetic oligonucleotide
caaatccctcgcccag

SEQ ID NO: 2932 - DNA, 16 bp, Artificial sequence
  Synthetic oligonucleotide
aggtacccttcatcta

SEQ ID NO: 2933 - DNA, 16 bp, Artificial sequence
  Synthetic oligonucleotide
tcaaccccaccaagtc

SEQ ID NO: 2934 - DNA, 16 bp, Artificial sequence
  Synthetic oligonucleotide
atgggatggacggaca

SEQ ID NO: 2935 - DNA, 16 bp, Artificial sequence
  Synthetic oligonucleotide
ccatcgcgaataatga

SEQ ID NO: 2936 - DNA, 16 bp, Artificial sequence
  Synthetic oligonucleotide
gctatagtgccatcag

SEQ ID NO: 2937 - DNA, 16 bp, Artificial sequence
  Synthetic oligonucleotide
tattgaatgagtgtcc

SEQ ID NO: 2938 - DNA, 16 bp, Artificial sequence
  Synthetic oligonucleotide
gtaagtcttcagtccc

SEQ ID NO: 2939 - DNA, 16 bp, Artificial sequence
  Synthetic oligonucleotide
aaaggtcgctgtgcat

SEQ ID NO: 2940 - DNA, 16 bp, Artificial sequence
  Synthetic oligonucleotide
gagtaatgaggcggga

SEQ ID NO: 2941 - DNA, 16 bp, Artificial sequence
  Synthetic oligonucleotide
gaacctacttgccttg

SEQ ID NO: 2942 - DNA, 16 bp, Artificial sequence
  Synthetic oligonucleotide
ctccgagtatccagca

SEQ ID NO: 2943 - DNA, 16 bp, Artificial sequence
  Synthetic oligonucleotide
aagagggatagtggtc

SEQ ID NO: 2944 - DNA, 16 bp, Artificial sequence
  Synthetic oligonucleotide
aacgcagtgagccacc

SEQ ID NO: 2945 - DNA, 16 bp, Artificial sequence
  Synthetic oligonucleotide
ccacgcggcgcaccgg

SEQ ID NO: 2946 - DNA, 16 bp, Artificial sequence
  Synthetic oligonucleotide
cggaatctagctcgcc

SEQ ID NO: 2947 - DNA, 16 bp, Artificial sequence
  Synthetic oligonucleotide
ttcgccggcaaggctg

SEQ ID NO: 2948 - DNA, 16 bp, Artificial sequence
  Synthetic oligonucleotide
agaaggtagggcacgg

SEQ ID NO: 2949 - DNA, 16 bp, Artificial sequence
  Synthetic oligonucleotide
ccacgcacccaggtcg

SEQ ID NO: 2950 - DNA, 16 bp, Artificial sequence
  Synthetic oligonucleotide
aggcgcaacagagcta

SEQ ID NO: 2951 - DNA, 16 bp, Artificial sequence
  Synthetic oligonucleotide
ccgcctaacccagtga

SEQ ID NO: 2952 - DNA, 16 bp, Artificial sequence
  Synthetic oligonucleotide
aacgataccaaagtcg

SEQ ID NO: 2953 - DNA, 16 bp, Artificial sequence
  Synthetic oligonucleotide
tgggattcacctacac

SEQ ID NO: 2954 - DNA, 16 bp, Artificial sequence
  Synthetic oligonucleotide
cctagttggcctttgc

SEQ ID NO: 2955 - DNA, 16 bp, Artificial sequence
  Synthetic oligonucleotide
acccatccagagtcgc

SEQ ID NO: 2956 - DNA, 16 bp, Artificial sequence
  Synthetic oligonucleotide
tcgcagcaagcccgaa

SEQ ID NO: 2957 - DNA, 16 bp, Artificial sequence
  Synthetic oligonucleotide
gccgcccggacgatgg

SEQ ID NO: 2958 - DNA, 16 bp, Artificial sequence
  Synthetic oligonucleotide
ggctaagagctcacct

SEQ ID NO: 2959 - DNA, 16 bp, Artificial sequence
  Synthetic oligonucleotide
tcggaaacacgcagct

SEQ ID NO: 2960 - DNA, 16 bp, Artificial sequence
  Synthetic oligonucleotide
atcgaaagtgttgact

SEQ ID NO: 2961 - DNA, 16 bp, Artificial sequence
  Synthetic oligonucleotide
agctttgtacttatgc

SEQ ID NO: 2962 - DNA, 16 bp, Artificial sequence
  Synthetic oligonucleotide
cggtgacagtgagaac

SEQ ID NO: 2963 - DNA, 16 bp, Artificial sequence
  Synthetic oligonucleotide
atttgtggtacagctg

SEQ ID NO: 2964 - DNA, 16 bp, Artificial sequence
  Synthetic oligonucleotide
tagcacaccagggctg

SEQ ID NO: 2965 - DNA, 16 bp, Artificial sequence
  Synthetic oligonucleotide
ccaaacagtatcccca

SEQ ID NO: 2966 - DNA, 16 bp, Artificial sequence
  Synthetic oligonucleotide
ctttctggcagtggtt

SEQ ID NO: 2967 - DNA, 16 bp, Artificial sequence
  Synthetic oligonucleotide
gctcagttctatacca

SEQ ID NO: 2968 - DNA, 16 bp, Artificial sequence
  Synthetic oligonucleotide
gcacgggttggtgcgg

SEQ ID NO: 2969 - DNA, 16 bp, Artificial sequence
  Synthetic oligonucleotide
ctctaggcagcgaccc

SEQ ID NO: 2970 - DNA, 16 bp, Artificial sequence
  Synthetic oligonucleotide
gtagcccaccgggcag

SEQ ID NO: 2971 - DNA, 16 bp, Artificial sequence
  Synthetic oligonucleotide
atcatagcagcttgcc

SEQ ID NO: 2972 - DNA, 16 bp, Artificial sequence
  Synthetic oligonucleotide
gggcgcacccgagagc

SEQ ID NO: 2973 - DNA, 16 bp, Artificial sequence
  Synthetic oligonucleotide
ggtaggtggcctccga

SEQ ID NO: 2974 - DNA, 16 bp, Artificial sequence
  Synthetic oligonucleotide
cagtccccagttccgc

SEQ ID NO: 2975 - DNA, 16 bp, Artificial sequence
  Synthetic oligonucleotide
gcacgaagcaccacgg

SEQ ID NO: 2976 - DNA, 16 bp, Artificial sequence
  Synthetic oligonucleotide
caggtcgcagtactcc

SEQ ID NO: 2977 - DNA, 16 bp, Artificial sequence
  Synthetic oligonucleotide
gtgccggctgcgcggg

SEQ ID NO: 2978 - DNA, 16 bp, Artificial sequence
  Synthetic oligonucleotide
ttcgccggcaaggctc

SEQ ID NO: 2979 - DNA, 16 bp, Artificial sequence
  Synthetic oligonucleotide
gctcagtgggccgttc

SEQ ID NO: 2980 - DNA, 16 bp, Artificial sequence
  Synthetic oligonucleotide
acagactcttgcggag

SEQ ID NO: 2981 - DNA, 16 bp, Artificial sequence
  Synthetic oligonucleotide
cgccaacgacgcgggt

SEQ ID NO: 2982 - DNA, 16 bp, Artificial sequence
  Synthetic oligonucleotide
agaaactgtggcccca

SEQ ID NO: 2983 - DNA, 16 bp, Artificial sequence
  Synthetic oligonucleotide
gggccggtcctgcagg

SEQ ID NO: 2984 - DNA, 16 bp, Artificial sequence
  Synthetic oligonucleotide
ctggcacggctcacag

SEQ ID NO: 2985 - DNA, 16 bp, Artificial sequence
  Synthetic oligonucleotide
ctgacgggcgagaagg

SEQ ID NO: 2986 - DNA, 16 bp, Artificial sequence
  Synthetic oligonucleotide
gcatcctcctgaaggc

SEQ ID NO: 2987 - DNA, 16 bp, Artificial sequence
  Synthetic oligonucleotide
cgacaggagcgcgcag

SEQ ID NO: 2988 - DNA, 16 bp, Artificial sequence
  Synthetic oligonucleotide
gagggtcgcgcggcgc

SEQ ID NO: 2989 - DNA, 16 bp, Artificial sequence
  Synthetic oligonucleotide
cctcgaactggtggcc

SEQ ID NO: 2990 - DNA, 16 bp, Artificial sequence
  Synthetic oligonucleotide
tgcgcctcctgcagga

SEQ ID NO: 2991 - DNA, 16 bp, Artificial sequence
  Synthetic oligonucleotide
aggatggaggatccgt

SEQ ID NO: 2992 - DNA, 16 bp, Artificial sequence
  Synthetic oligonucleotide
tgccgccctcgaggaa

SEQ ID NO: 2993 - DNA, 16 bp, Artificial sequence
  Synthetic oligonucleotide
gcagcttggtcctcac

SEQ ID NO: 2994 - DNA, 16 bp, Artificial sequence
  Synthetic oligonucleotide
ggtcaccacagcccga

SEQ ID NO: 2995 - DNA, 16 bp, Artificial sequence
  Synthetic oligonucleotide
gtaggccacatcggtg

SEQ ID NO: 2996 - DNA, 16 bp, Artificial sequence
  Synthetic oligonucleotide
aggaaacggtgtgctc

SEQ ID NO: 2997 - DNA, 16 bp, Artificial sequence
  Synthetic oligonucleotide
gggaaagatgagtccc

SEQ ID NO: 2998 - DNA, 16 bp, Artificial sequence
  Synthetic oligonucleotide
ttgccttccatgcccc

SEQ ID NO: 2999 - DNA, 16 bp, Artificial sequence
  Synthetic oligonucleotide
catcctggcgcggagc

SEQ ID NO: 3000 - DNA, 16 bp, Artificial sequence
  Synthetic oligonucleotide
gcactttattgagttc

SEQ ID NO: 3001 - DNA, 16 bp, Artificial sequence
  Synthetic oligonucleotide
gaccccccagaacaat

SEQ ID NO: 3002 - DNA, 16 bp, Artificial sequence
  Synthetic oligonucleotide
cacctttccacatagg

SEQ ID NO: 3003 - DNA, 16 bp, Artificial sequence
  Synthetic oligonucleotide
caccgatctgttgcta

SEQ ID NO: 3004 - DNA, 16 bp, Artificial sequence
  Synthetic oligonucleotide
ccaaggtggaatctac

SEQ ID NO: 3005 - DNA, 16 bp, Artificial sequence
  Synthetic oligonucleotide
accaggtaggcactag

SEQ ID NO: 3006 - DNA, 16 bp, Artificial sequence
  Synthetic oligonucleotide
cttagacacagcccat

SEQ ID NO: 3007 - DNA, 16 bp, Artificial sequence
  Synthetic oligonucleotide
actcaaatccctcgcc

SEQ ID NO: 3008 - DNA, 16 bp, Artificial sequence
  Synthetic oligonucleotide
gcaggtacccttcatc

SEQ ID NO: 3009 - DNA, 16 bp, Artificial sequence
  Synthetic oligonucleotide
gactcaaccccaccaa

SEQ ID NO: 3010 - DNA, 16 bp, Artificial sequence
  Synthetic oligonucleotide
gatgggatggacggac

SEQ ID NO: 3011 - DNA, 16 bp, Artificial sequence
  Synthetic oligonucleotide
accatcgcgaataatg

SEQ ID NO: 3012 - DNA, 16 bp, Artificial sequence
  Synthetic oligonucleotide
acttgattcaggtgtg

SEQ ID NO: 3013 - DNA, 16 bp, Artificial sequence
  Synthetic oligonucleotide
ctattgaatgagtgtc

SEQ ID NO: 3014 - DNA, 16 bp, Artificial sequence
  Synthetic oligonucleotide
gggtaagtcttcagtc

SEQ ID NO: 3015 - DNA, 16 bp, Artificial sequence
  Synthetic oligonucleotide
aaaaggtcgctgtgca

SEQ ID NO: 3016 - DNA, 16 bp, Artificial sequence
  Synthetic oligonucleotide
agagtaatgaggcggg

SEQ ID NO: 3017 - DNA, 16 bp, Artificial sequence
  Synthetic oligonucleotide
tgaacctacttgcctt

SEQ ID NO: 3018 - DNA, 16 bp, Artificial sequence
  Synthetic oligonucleotide
tctccgagtatccagc

SEQ ID NO: 3019 - DNA, 16 bp, Artificial sequence
  Synthetic oligonucleotide
cgttcccaaccatctg

SEQ ID NO: 3020 - DNA, 16 bp, Artificial sequence
  Synthetic oligonucleotide
gaacgcagtgagccac

SEQ ID NO: 3021 - DNA, 16 bp, Artificial sequence
  Synthetic oligonucleotide
ccccacgcggcgcacc

SEQ ID NO: 3022 - DNA, 16 bp, Artificial sequence
  Synthetic oligonucleotide
ccggaatctagctcgc

SEQ ID NO: 3023 - DNA, 16 bp, Artificial sequence
  Synthetic oligonucleotide
cgccggtcctgcaggc

SEQ ID NO: 3024 - DNA, 16 bp, Artificial sequence
  Synthetic oligonucleotide
gagaaggtagggcacg

SEQ ID NO: 3025 - DNA, 16 bp, Artificial sequence
  Synthetic oligonucleotide
cttcccgtccccgcgg

SEQ ID NO: 3026 - DNA, 16 bp, Artificial sequence
  Synthetic oligonucleotide
aaggcgcaacagagct

SEQ ID NO: 3027 - DNA, 16 bp, Artificial sequence
  Synthetic oligonucleotide
tccgcctaacccagtg

SEQ ID NO: 3028 - DNA, 16 bp, Artificial sequence
  Synthetic oligonucleotide
gaacgataccaaagtc

SEQ ID NO: 3029 - DNA, 16 bp, Artificial sequence
  Synthetic oligonucleotide
acctgggattcaccta

SEQ ID NO: 3030 - DNA, 16 bp, Artificial sequence
  Synthetic oligonucleotide
tcctagttggcctttg

SEQ ID NO: 3031 - DNA, 16 bp, Artificial sequence
  Synthetic oligonucleotide
cggaaacagaaacccc

SEQ ID NO: 3032 - DNA, 16 bp, Artificial sequence
  Synthetic oligonucleotide
ctcgcagcaagcccga

SEQ ID NO: 3033 - DNA, 16 bp, Artificial sequence
  Synthetic oligonucleotide
tgccgcccggacgatg

SEQ ID NO: 3034 - DNA, 16 bp, Artificial sequence
  Synthetic oligonucleotide
cgggctaagagctcac

SEQ ID NO: 3035 - DNA, 16 bp, Artificial sequence
  Synthetic oligonucleotide
gtcggaaacacgcagc

SEQ ID NO: 3036 - DNA, 16 bp, Artificial sequence
  Synthetic oligonucleotide
aatcgaaagtgttgac

SEQ ID NO: 3037 - DNA, 16 bp, Artificial sequence
  Synthetic oligonucleotide
tgtgctcttcagcttt

SEQ ID NO: 3038 - DNA, 16 bp, Artificial sequence
  Synthetic oligonucleotide
ccggtgacagtgagaa

SEQ ID NO: 3039 - DNA, 16 bp, Artificial sequence
  Synthetic oligonucleotide
catttgtggtacagct

SEQ ID NO: 3040 - DNA, 16 bp, Artificial sequence
  Synthetic oligonucleotide
gtggtagcacaccagg

SEQ ID NO: 3041 - DNA, 16 bp, Artificial sequence
  Synthetic oligonucleotide
tccaaacagtatcccc

SEQ ID NO: 3042 - DNA, 16 bp, Artificial sequence
  Synthetic oligonucleotide
tctttctggcagtggt

SEQ ID NO: 3043 - DNA, 16 bp, Artificial sequence
  Synthetic oligonucleotide
cccttgcactggcatc

SEQ ID NO: 3044 - DNA, 16 bp, Artificial sequence
  Synthetic oligonucleotide
ggcacgggttggtgcg

SEQ ID NO: 3045 - DNA, 16 bp, Artificial sequence
  Synthetic oligonucleotide
cctctaggcagcgacc

SEQ ID NO: 3046 - DNA, 16 bp, Artificial sequence
  Synthetic oligonucleotide
gtgtagcccaccgggc

SEQ ID NO: 3047 - DNA, 16 bp, Artificial sequence
  Synthetic oligonucleotide
catcatagcagcttgc

SEQ ID NO: 3048 - DNA, 16 bp, Artificial sequence
  Synthetic oligonucleotide
agggcgcacccgagag

SEQ ID NO: 3049 - DNA, 16 bp, Artificial sequence
  Synthetic oligonucleotide
cggtaggtggcctccg

SEQ ID NO: 3050 - DNA, 16 bp, Artificial sequence
  Synthetic oligonucleotide
ccagtccccagttccg

SEQ ID NO: 3051 - DNA, 16 bp, Artificial sequence
  Synthetic oligonucleotide
agcacgaagcaccacg

SEQ ID NO: 3052 - DNA, 16 bp, Artificial sequence
  Synthetic oligonucleotide
ccaggtcgcagtactc

SEQ ID NO: 3053 - DNA, 16 bp, Artificial sequence
  Synthetic oligonucleotide
gcggtgccggctgcgc

SEQ ID NO: 3054 - DNA, 16 bp, Artificial sequence
  Synthetic oligonucleotide
cttcgccggcaaggct

SEQ ID NO: 3055 - DNA, 16 bp, Artificial sequence
  Synthetic oligonucleotide
cgcagctcagtgggcc

SEQ ID NO: 3056 - DNA, 16 bp, Artificial sequence
  Synthetic oligonucleotide
gacagactcttgcgga

SEQ ID NO: 3057 - DNA, 16 bp, Artificial sequence
  Synthetic oligonucleotide
ccgccaacgacgcggg

SEQ ID NO: 3058 - DNA, 16 bp, Artificial sequence
  Synthetic oligonucleotide
cagaaactgtggcccc

SEQ ID NO: 3059 - DNA, 16 bp, Artificial sequence
  Synthetic oligonucleotide
cgggccggtcctgcag

SEQ ID NO: 3060 - DNA, 16 bp, Artificial sequence
  Synthetic oligonucleotide
cgtctggcacggctca

SEQ ID NO: 3061 - DNA, 16 bp, Artificial sequence
  Synthetic oligonucleotide
gctgacgggcgagaag

SEQ ID NO: 3062 - DNA, 16 bp, Artificial sequence
  Synthetic oligonucleotide
ccgcatcctcctgaag

SEQ ID NO: 3063 - DNA, 16 bp, Artificial sequence
  Synthetic oligonucleotide
gcgacaggagcgcgca

SEQ ID NO: 3064 - DNA, 16 bp, Artificial sequence
  Synthetic oligonucleotide
ggagggtcgcgcggcg

SEQ ID NO: 3065 - DNA, 16 bp, Artificial sequence
  Synthetic oligonucleotide
ccctcgaactggtggc

SEQ ID NO: 3066 - DNA, 16 bp, Artificial sequence
  Synthetic oligonucleotide
tacctgcgcctcctgc

SEQ ID NO: 3067 - DNA, 16 bp, Artificial sequence
  Synthetic oligonucleotide
gaggatggaggatccg

SEQ ID NO: 3068 - DNA, 16 bp, Artificial sequence
  Synthetic oligonucleotide
tcggtgccgccctcga

SEQ ID NO: 3069 - DNA, 16 bp, Artificial sequence
  Synthetic oligonucleotide
ctctgcagcttggtcc

SEQ ID NO: 3070 - DNA, 16 bp, Artificial sequence
  Synthetic oligonucleotide
tgcggtcaccacagcc

SEQ ID NO: 3071 - DNA, 16 bp, Artificial sequence
  Synthetic oligonucleotide
agtaggccacatcggt

SEQ ID NO: 3072 - DNA, 16 bp, Artificial sequence
  Synthetic oligonucleotide
caggaaacggtgtgct

SEQ ID NO: 3073 - DNA, 16 bp, Artificial sequence
  Synthetic oligonucleotide
agggaaagatgagtcc

SEQ ID NO: 3074 - DNA, 16 bp, Artificial sequence
  Synthetic oligonucleotide
tcttgccttccatgcc

SEQ ID NO: 3075 - DNA, 16 bp, Artificial sequence
  Synthetic oligonucleotide
ccatcctggcgcggag

SEQ ID NO: 3076 - DNA, 16 bp, Artificial sequence
  Synthetic oligonucleotide
agcactttattgagtt

SEQ ID NO: 3077 - DNA, 16 bp, Artificial sequence
  Synthetic oligonucleotide
cgaccccccagaacaa

SEQ ID NO: 3078 - DNA, 16 bp, Artificial sequence
  Synthetic oligonucleotide
tccgggctggcctcac

SEQ ID NO: 3079 - DNA, 16 bp, Artificial sequence
  Synthetic oligonucleotide
ccaccgatctgttgct

SEQ ID NO: 3080 - DNA, 16 bp, Artificial sequence
  Synthetic oligonucleotide
ttaccgactgtgtgct

SEQ ID NO: 3081 - DNA, 16 bp, Artificial sequence
  Synthetic oligonucleotide
tagcaccaggtaggca

SEQ ID NO: 3082 - DNA, 16 bp, Artificial sequence
  Synthetic oligonucleotide
gcacttagacacagcc

SEQ ID NO: 3083 - DNA, 16 bp, Artificial sequence
  Synthetic oligonucleotide
aactcaaatccctcgc

SEQ ID NO: 3084 - DNA, 16 bp, Artificial sequence
  Synthetic oligonucleotide
ggcaggtacccttcat

SEQ ID NO: 3085 - DNA, 16 bp, Artificial sequence
  Synthetic oligonucleotide
tagagactcaacccca

SEQ ID NO: 3086 - DNA, 16 bp, Artificial sequence
  Synthetic oligonucleotide
gcagatgggatggacg

SEQ ID NO: 3087 - DNA, 16 bp, Artificial sequence
  Synthetic oligonucleotide
aaccatcgcgaataat

SEQ ID NO: 3088 - DNA, 16 bp, Artificial sequence
  Synthetic oligonucleotide
acacttgattcaggtg

SEQ ID NO: 3089 - DNA, 16 bp, Artificial sequence
  Synthetic oligonucleotide
cctattgaatgagtgt

SEQ ID NO: 3090 - DNA, 16 bp, Artificial sequence
  Synthetic oligonucleotide
ttgggtaagtcttcag

SEQ ID NO: 3091 - DNA, 16 bp, Artificial sequence
  Synthetic oligonucleotide
aaaaaggtcgctgtgc

SEQ ID NO: 3092 - DNA, 16 bp, Artificial sequence
  Synthetic oligonucleotide
gagagtaatgaggcgg

SEQ ID NO: 3093 - DNA, 16 bp, Artificial sequence
  Synthetic oligonucleotide
ttgaacctacttgcct

SEQ ID NO: 3094 - DNA, 16 bp, Artificial sequence
  Synthetic oligonucleotide
gtctccgagtatccag

SEQ ID NO: 3095 - DNA, 16 bp, Artificial sequence
  Synthetic oligonucleotide
gcccgttcccaaccat

SEQ ID NO: 3096 - DNA, 16 bp, Artificial sequence
  Synthetic oligonucleotide
gggaacgcagtgagcc

SEQ ID NO: 3097 - DNA, 16 bp, Artificial sequence
  Synthetic oligonucleotide
agccccacgcggcgca

SEQ ID NO: 3098 - DNA, 16 bp, Artificial sequence
  Synthetic oligonucleotide
gccggaatctagctcg

SEQ ID NO: 3099 - DNA, 16 bp, Artificial sequence
  Synthetic oligonucleotide
tcgccggtcctgcagg

SEQ ID NO: 3100 - DNA, 16 bp, Artificial sequence
  Synthetic oligonucleotide
ggcgggagaaggtagg

SEQ ID NO: 3101 - DNA, 16 bp, Artificial sequence
  Synthetic oligonucleotide
cgggcggagaggagcg

SEQ ID NO: 3102 - DNA, 16 bp, Artificial sequence
  Synthetic oligonucleotide
accctcgaactggtgg

SEQ ID NO: 3103 - DNA, 16 bp, Artificial sequence
  Synthetic oligonucleotide
ttccgcctaacccagt

SEQ ID NO: 3104 - DNA, 16 bp, Artificial sequence
  Synthetic oligonucleotide
ggaacgataccaaagt

SEQ ID NO: 3105 - DNA, 16 bp, Artificial sequence
  Synthetic oligonucleotide
tacctgggattcacct

SEQ ID NO: 3106 - DNA, 16 bp, Artificial sequence
  Synthetic oligonucleotide
gtcctagttggccttt

SEQ ID NO: 3107 - DNA, 16 bp, Artificial sequence
  Synthetic oligonucleotide
cggagcggaaacagaa

SEQ ID NO: 3108 - DNA, 16 bp, Artificial sequence
  Synthetic oligonucleotide
tctcgcagcaagcccg

SEQ ID NO: 3109 - DNA, 16 bp, Artificial sequence
  Synthetic oligonucleotide
cgcttgccgcccggac

SEQ ID NO: 3110 - DNA, 16 bp, Artificial sequence
  Synthetic oligonucleotide
ccgggctaagagctca

SEQ ID NO: 3111 - DNA, 16 bp, Artificial sequence
  Synthetic oligonucleotide
ggtcggaaacacgcag

SEQ ID NO: 3112 - DNA, 16 bp, Artificial sequence
  Synthetic oligonucleotide
tgtgtgctcttcagct

SEQ ID NO: 3113 - DNA, 16 bp, Artificial sequence
  Synthetic oligonucleotide
cccggtgacagtgaga

SEQ ID NO: 3114 - DNA, 16 bp, Artificial sequence
  Synthetic oligonucleotide
acatttgtggtacagc

SEQ ID NO: 3115 - DNA, 16 bp, Artificial sequence
  Synthetic oligonucleotide
aaccggagaagctgag

SEQ ID NO: 3116 - DNA, 16 bp, Artificial sequence
  Synthetic oligonucleotide
acccttgcactggcat

SEQ ID NO: 3117 - DNA, 16 bp, Artificial sequence
  Synthetic oligonucleotide
aggcacgggttggtgc

SEQ ID NO: 3118 - DNA, 16 bp, Artificial sequence
  Synthetic oligonucleotide
acctctaggcagcgac

SEQ ID NO: 3119 - DNA, 16 bp, Artificial sequence
  Synthetic oligonucleotide
cggtgtagcccaccgg

SEQ ID NO: 3120 - DNA, 16 bp, Artificial sequence
  Synthetic oligonucleotide
ccatcatagcagcttg

SEQ ID NO: 3121 - DNA, 16 bp, Artificial sequence
  Synthetic oligonucleotide
cagggcgcacccgaga

SEQ ID NO: 3122 - DNA, 16 bp, Artificial sequence
  Synthetic oligonucleotide
ccggtaggtggcctcc

SEQ ID NO: 3123 - DNA, 16 bp, Artificial sequence
  Synthetic oligonucleotide
gtggccgcccagtccc

SEQ ID NO: 3124 - DNA, 16 bp, Artificial sequence
  Synthetic oligonucleotide
cagcacgaagcaccac

SEQ ID NO: 3125 - DNA, 16 bp, Artificial sequence
  Synthetic oligonucleotide
gccaggtcgcagtact

SEQ ID NO: 3126 - DNA, 16 bp, Artificial sequence
  Synthetic oligonucleotide
cggcggtgccggctgc

SEQ ID NO: 3127 - DNA, 16 bp, Artificial sequence
  Synthetic oligonucleotide
cgcttcgccggcaagg

SEQ ID NO: 3128 - DNA, 16 bp, Artificial sequence
  Synthetic oligonucleotide
ccgcagctcagtgggc

SEQ ID NO: 3129 - DNA, 16 bp, Artificial sequence
  Synthetic oligonucleotide
agacagactcttgcgg

SEQ ID NO: 3130 - DNA, 16 bp, Artificial sequence
  Synthetic oligonucleotide
cccgccaacgacgcgg

SEQ ID NO: 3131 - DNA, 16 bp, Artificial sequence
  Synthetic oligonucleotide
gcagaaactgtggccc

SEQ ID NO: 3132 - DNA, 16 bp, Artificial sequence
  Synthetic oligonucleotide
gagcgcacggccaacg

SEQ ID NO: 3133 - DNA, 16 bp, Artificial sequence
  Synthetic oligonucleotide
agctgacgggcgagaa

SEQ ID NO: 3134 - DNA, 16 bp, Artificial sequence
  Synthetic oligonucleotide
tccgcatcctcctgaa

SEQ ID NO: 3135 - DNA, 16 bp, Artificial sequence
  Synthetic oligonucleotide
ggcgacaggagcgcgc

SEQ ID NO: 3136 - DNA, 16 bp, Artificial sequence
  Synthetic oligonucleotide
cggagggtcgcgcggc

SEQ ID NO: 3137 - DNA, 16 bp, Artificial sequence
  Synthetic oligonucleotide
gtacctgcgcctcctg

SEQ ID NO: 3138 - DNA, 16 bp, Artificial sequence
  Synthetic oligonucleotide
cgcagagcatgccggg

SEQ ID NO: 3139 - DNA, 16 bp, Artificial sequence
  Synthetic oligonucleotide
atcggtgccgccctcg

SEQ ID NO: 3140 - DNA, 16 bp, Artificial sequence
  Synthetic oligonucleotide
cagggtgagccggcgc

SEQ ID NO: 3141 - DNA, 16 bp, Artificial sequence
  Synthetic oligonucleotide
ttgcggtcaccacagc

SEQ ID NO: 3142 - DNA, 16 bp, Artificial sequence
  Synthetic oligonucleotide
tagtaggccacatcgg

SEQ ID NO: 3143 - DNA, 16 bp, Artificial sequence
  Synthetic oligonucleotide
tcaggaaacggtgtgc

SEQ ID NO: 3144 - DNA, 16 bp, Artificial sequence
  Synthetic oligonucleotide
ggagggaaagatgagt

SEQ ID NO: 3145 - DNA, 16 bp, Artificial sequence
  Synthetic oligonucleotide
atcttgccttccatgc

SEQ ID NO: 3146 - DNA, 16 bp, Artificial sequence
  Synthetic oligonucleotide
gccatcctggcgcgga

SEQ ID NO: 3147 - DNA, 16 bp, Artificial sequence
  Synthetic oligonucleotide
aagcactttattgagt

SEQ ID NO: 3148 - DNA, 16 bp, Artificial sequence
  Synthetic oligonucleotide
gcgaccccccagaaca

SEQ ID NO: 3149 - DNA, 16 bp, Artificial sequence
  Synthetic oligonucleotide
ttccgggctggcctca

SEQ ID NO: 3150 - DNA, 16 bp, Artificial sequence
  Synthetic oligonucleotide
gccaccgatctgttgc

SEQ ID NO: 3151 - DNA, 16 bp, Artificial sequence
  Synthetic oligonucleotide
cttaccgactgtgtgc

SEQ ID NO: 3152 - DNA, 16 bp, Artificial sequence
  Synthetic oligonucleotide
gacctagcaccaggta

SEQ ID NO: 3153 - DNA, 16 bp, Artificial sequence
  Synthetic oligonucleotide
gggcacttagacacag

SEQ ID NO: 3154 - DNA, 16 bp, Artificial sequence
  Synthetic oligonucleotide
gaactcaaatccctcg

SEQ ID NO: 3155 - DNA, 16 bp, Artificial sequence
  Synthetic oligonucleotide
tggcaggtacccttca

SEQ ID NO: 3156 - DNA, 16 bp, Artificial sequence
  Synthetic oligonucleotide
ttagagactcaacccc

SEQ ID NO: 3157 - DNA, 16 bp, Artificial sequence
  Synthetic oligonucleotide
catgaagttgtgtgcc

SEQ ID NO: 3158 - DNA, 16 bp, Artificial sequence
  Synthetic oligonucleotide
ataaccatcgcgaata

SEQ ID NO: 3159 - DNA, 16 bp, Artificial sequence
  Synthetic oligonucleotide
gacacttgattcaggt

SEQ ID NO: 3160 - DNA, 16 bp, Artificial sequence
  Synthetic oligonucleotide
tcctattgaatgagtg

SEQ ID NO: 3161 - DNA, 16 bp, Artificial sequence
  Synthetic oligonucleotide
tccacaacctgctagc

SEQ ID NO: 3162 - DNA, 16 bp, Artificial sequence
  Synthetic oligonucleotide
caaaaaggtcgctgtg

SEQ ID NO: 3163 - DNA, 16 bp, Artificial sequence
  Synthetic oligonucleotide
ggagagtaatgaggcg

SEQ ID NO: 3164 - DNA, 16 bp, Artificial sequence
  Synthetic oligonucleotide
cttgaacctacttgcc

SEQ ID NO: 3165 - DNA, 16 bp, Artificial sequence
  Synthetic oligonucleotide
aagtctccgagtatcc

SEQ ID NO: 3166 - DNA, 16 bp, Artificial sequence
  Synthetic oligonucleotide
tggcccgttcccaacc

SEQ ID NO: 3167 - DNA, 16 bp, Artificial sequence
  Synthetic oligonucleotide
aagcccgtcccacctg

SEQ ID NO: 3168 - DNA, 16 bp, Artificial sequence
  Synthetic oligonucleotide
acccagccccacgcgg

SEQ ID NO: 3169 - DNA, 16 bp, Artificial sequence
  Synthetic oligonucleotide
tggccggaatctagct

SEQ ID NO: 3170 - DNA, 16 bp, Artificial sequence
  Synthetic oligonucleotide
ctcgccggtcctgcag

SEQ ID NO: 3171 - DNA, 16 bp, Artificial sequence
  Synthetic oligonucleotide
cgtggaaagaagggtg

SEQ ID NO: 3172 - DNA, 16 bp, Artificial sequence
  Synthetic oligonucleotide
ccgggcggagaggagc

SEQ ID NO: 3173 - DNA, 16 bp, Artificial sequence
  Synthetic oligonucleotide
taccctcgaactggtg

SEQ ID NO: 3174 - DNA, 16 bp, Artificial sequence
  Synthetic oligonucleotide
tcttccgcctaaccca

SEQ ID NO: 3175 - DNA, 16 bp, Artificial sequence
  Synthetic oligonucleotide
cggaacgataccaaag

SEQ ID NO: 3176 - DNA, 16 bp, Artificial sequence
  Synthetic oligonucleotide
ctacctgggattcacc

SEQ ID NO: 3177 - DNA, 16 bp, Artificial sequence
  Synthetic oligonucleotide
cgtcctagttggcctt

SEQ ID NO: 3178 - DNA, 16 bp, Artificial sequence
  Synthetic oligonucleotide
gcggagcggaaacaga

SEQ ID NO: 3179 - DNA, 16 bp, Artificial sequence
  Synthetic oligonucleotide
tctctcgcagcaagcc

SEQ ID NO: 3180 - DNA, 16 bp, Artificial sequence
  Synthetic oligonucleotide
ccccatctgacaacgc

SEQ ID NO: 3181 - DNA, 16 bp, Artificial sequence
  Synthetic oligonucleotide
accgggctaagagctc

SEQ ID NO: 3182 - DNA, 16 bp, Artificial sequence
  Synthetic oligonucleotide
gggtcggaaacacgca

SEQ ID NO: 3183 - DNA, 16 bp, Artificial sequence
  Synthetic oligonucleotide
gaatcgaaagtgttga

SEQ ID NO: 3184 - DNA, 16 bp, Artificial sequence
  Synthetic oligonucleotide
gggtggtagcacacca

SEQ ID NO: 3185 - DNA, 16 bp, Artificial sequence
  Synthetic oligonucleotide
cagtggtctttcactt

SEQ ID NO: 3186 - DNA, 16 bp, Artificial sequence
  Synthetic oligonucleotide
tgcgggccggtcctgc

SEQ ID NO: 3187 - DNA, 16 bp, Artificial sequence
  Synthetic oligonucleotide
cccctcgaactggtgg

SEQ ID NO: 3188 - DNA, 16 bp, Artificial sequence
  Synthetic oligonucleotide
gtccgttggtccagct

SEQ ID NO: 3189 - DNA, 16 bp, Artificial sequence
  Synthetic oligonucleotide
ggaatcgaaagtgttg

SEQ ID NO: 3190 - DNA, 16 bp, Artificial sequence
  Synthetic oligonucleotide
ctgtgtgctcttcagc

SEQ ID NO: 3191 - DNA, 16 bp, Artificial sequence
  Synthetic oligonucleotide
tccccggtgacagtga

SEQ ID NO: 3192 - DNA, 16 bp, Artificial sequence
  Synthetic oligonucleotide
gtacatttgtggtaca

SEQ ID NO: 3193 - DNA, 16 bp, Artificial sequence
  Synthetic oligonucleotide
cctgatcaaagttggg

SEQ ID NO: 3194 - DNA, 16 bp, Artificial sequence
  Synthetic oligonucleotide
gcagtggtctttcact

SEQ ID NO: 3195 - DNA, 16 bp, Artificial sequence
  Synthetic oligonucleotide
aaaccggagaagctga

SEQ ID NO: 3196 - DNA, 16 bp, Artificial sequence
  Synthetic oligonucleotide
ggacccttgcactggc

SEQ ID NO: 3197 - DNA, 16 bp, Artificial sequence
  Synthetic oligonucleotide
gaggcacgggttggtg

SEQ ID NO: 3198 - DNA, 16 bp, Artificial sequence
  Synthetic oligonucleotide
cacctctaggcagcga

SEQ ID NO: 3199 - DNA, 16 bp, Artificial sequence
  Synthetic oligonucleotide
ccggtgtagcccaccg

SEQ ID NO: 3200 - DNA, 16 bp, Artificial sequence
  Synthetic oligonucleotide
ggccatcatagcagct

SEQ ID NO: 3201 - DNA, 16 bp, Artificial sequence
  Synthetic oligonucleotide
acagggcgcacccgag

SEQ ID NO: 3202 - DNA, 16 bp, Artificial sequence
  Synthetic oligonucleotide
tccggtaggtggcctc

SEQ ID NO: 3203 - DNA, 16 bp, Artificial sequence
  Synthetic oligonucleotide
gttccggcagaaggcg

SEQ ID NO: 3204 - DNA, 16 bp, Artificial sequence
  Synthetic oligonucleotide
gttcagcacgaagcac

SEQ ID NO: 3205 - DNA, 16 bp, Artificial sequence
  Synthetic oligonucleotide
tgccaggtcgcagtac

SEQ ID NO: 3206 - DNA, 16 bp, Artificial sequence
  Synthetic oligonucleotide
tcggcggtgccggctg

SEQ ID NO: 3207 - DNA, 16 bp, Artificial sequence
  Synthetic oligonucleotide
ccgcttcgccggcaag

SEQ ID NO: 3208 - DNA, 16 bp, Artificial sequence
  Synthetic oligonucleotide
cccgcagctcagtggg

SEQ ID NO: 3209 - DNA, 16 bp, Artificial sequence
  Synthetic oligonucleotide
aagacagactcttgcg

SEQ ID NO: 3210 - DNA, 16 bp, Artificial sequence
  Synthetic oligonucleotide
gcccgccaacgacgcg

SEQ ID NO: 3211 - DNA, 16 bp, Artificial sequence
  Synthetic oligonucleotide
cgcagaaactgtggcc

SEQ ID NO: 3212 - DNA, 16 bp, Artificial sequence
  Synthetic oligonucleotide
gtgcgggccggtcctg

SEQ ID NO: 3213 - DNA, 16 bp, Artificial sequence
  Synthetic oligonucleotide
aggagcgcacggccaa

SEQ ID NO: 3214 - DNA, 16 bp, Artificial sequence
  Synthetic oligonucleotide
ctggtagctgacgggc

SEQ ID NO: 3215 - DNA, 16 bp, Artificial sequence
  Synthetic oligonucleotide
gtccgcatcctcctga

SEQ ID NO: 3216 - DNA, 16 bp, Artificial sequence
  Synthetic oligonucleotide
aggcgacaggagcgcg

SEQ ID NO: 3217 - DNA, 16 bp, Artificial sequence
  Synthetic oligonucleotide
tcggagggtcgcgcgg

SEQ ID NO: 3218 - DNA, 16 bp, Artificial sequence
  Synthetic oligonucleotide
ccccctcgaactggtg

SEQ ID NO: 3219 - DNA, 16 bp, Artificial sequence
  Synthetic oligonucleotide
cggtacctgcgcctcc

SEQ ID NO: 3220 - DNA, 16 bp, Artificial sequence
  Synthetic oligonucleotide
gcgcagagcatgccgg

SEQ ID NO: 3221 - DNA, 16 bp, Artificial sequence
  Synthetic oligonucleotide
catcggtgccgccctc

SEQ ID NO: 3222 - DNA, 16 bp, Artificial sequence
  Synthetic oligonucleotide
gcagggtgagccggcg

SEQ ID NO: 3223 - DNA, 16 bp, Artificial sequence
  Synthetic oligonucleotide
tgttgcggtcaccaca

SEQ ID NO: 3224 - DNA, 16 bp, Artificial sequence
  Synthetic oligonucleotide
gtagtaggccacatcg

SEQ ID NO: 3225 - DNA, 16 bp, Artificial sequence
  Synthetic oligonucleotide
atcaggaaacggtgtg

SEQ ID NO: 3226 - DNA, 16 bp, Artificial sequence
  Synthetic oligonucleotide
ggaatcaccaaggagg

SEQ ID NO: 3227 - DNA, 16 bp, Artificial sequence
  Synthetic oligonucleotide
caatcttgccttccat

SEQ ID NO: 3228 - DNA, 16 bp, Artificial sequence
  Synthetic oligonucleotide
cgccatcctggcgcgg

SEQ ID NO: 3229 - DNA, 16 bp, Artificial sequence
  Synthetic oligonucleotide
aaagcactttattgag

SEQ ID NO: 3230 - DNA, 16 bp, Artificial sequence
  Synthetic oligonucleotide
agcgaccccccagaac

SEQ ID NO: 3231 - DNA, 16 bp, Artificial sequence
  Synthetic oligonucleotide
ccttccgggctggcct

SEQ ID NO: 3232 - DNA, 16 bp, Artificial sequence
  Synthetic oligonucleotide
tgccaccgatctgttg

SEQ ID NO: 3233 - DNA, 16 bp, Artificial sequence
  Synthetic oligonucleotide
ggccacttaccgactg

SEQ ID NO: 3234 - DNA, 16 bp, Artificial sequence
  Synthetic oligonucleotide
agacctagcaccaggt

SEQ ID NO: 3235 - DNA, 16 bp, Artificial sequence
  Synthetic oligonucleotide
gtgggcacttagacac

SEQ ID NO: 3236 - DNA, 16 bp, Artificial sequence
  Synthetic oligonucleotide
tcaacctggtttcaca

SEQ ID NO: 3237 - DNA, 16 bp, Artificial sequence
  Synthetic oligonucleotide
atggcaggtacccttc

SEQ ID NO: 3238 - DNA, 16 bp, Artificial sequence
  Synthetic oligonucleotide
cttagagactcaaccc

SEQ ID NO: 3239 - DNA, 16 bp, Artificial sequence
  Synthetic oligonucleotide
gcatgaagttgtgtgc

SEQ ID NO: 3240 - DNA, 16 bp, Artificial sequence
  Synthetic oligonucleotide
cataaccatcgcgaat

SEQ ID NO: 3241 - DNA, 16 bp, Artificial sequence
  Synthetic oligonucleotide
gttagacacttgattc

SEQ ID NO: 3242 - DNA, 16 bp, Artificial sequence
  Synthetic oligonucleotide
ctcctattgaatgagt

SEQ ID NO: 3243 - DNA, 16 bp, Artificial sequence
  Synthetic oligonucleotide
gagtagactcctgact

SEQ ID NO: 3244 - DNA, 16 bp, Artificial sequence
  Synthetic oligonucleotide
tcaaaaaggtcgctgt

SEQ ID NO: 3245 - DNA, 16 bp, Artificial sequence
  Synthetic oligonucleotide
gtgataccaggagagt

SEQ ID NO: 3246 - DNA, 16 bp, Artificial sequence
  Synthetic oligonucleotide
tcttgaacctacttgc

SEQ ID NO: 3247 - DNA, 16 bp, Artificial sequence
  Synthetic oligonucleotide
ccaagtctccgagtat

SEQ ID NO: 3248 - DNA, 16 bp, Artificial sequence
  Synthetic oligonucleotide
ctggcccgttcccaac

SEQ ID NO: 3249 - DNA, 16 bp, Artificial sequence
  Synthetic oligonucleotide
ggcaagcccgtcccac

SEQ ID NO: 3250 - DNA, 16 bp, Artificial sequence
  Synthetic oligonucleotide
ctgtagccacacgacg

SEQ ID NO: 3251 - DNA, 16 bp, Artificial sequence
  Synthetic oligonucleotide
ctggccggaatctagc

SEQ ID NO: 3252 - DNA, 16 bp, Artificial sequence
  Synthetic oligonucleotide
actcgccggtcctgca

SEQ ID NO: 3253 - DNA, 16 bp, Artificial sequence
  Synthetic oligonucleotide
ccgggagctccggagg

SEQ ID NO: 3254 - DNA, 16 bp, Artificial sequence
  Synthetic oligonucleotide
cccgggcggagaggag

SEQ ID NO: 3255 - DNA, 16 bp, Artificial sequence
  Synthetic oligonucleotide
ctaccctcgaactggt

SEQ ID NO: 3256 - DNA, 16 bp, Artificial sequence
  Synthetic oligonucleotide
cttcttccgcctaacc

SEQ ID NO: 3257 - DNA, 16 bp, Artificial sequence
  Synthetic oligonucleotide
ccggaacgataccaaa

SEQ ID NO: 3258 - DNA, 16 bp, Artificial sequence
  Synthetic oligonucleotide
gccctgggattctacc

SEQ ID NO: 3259 - DNA, 16 bp, Artificial sequence
  Synthetic oligonucleotide
tagcccggagcgcggg

SEQ ID NO: 3260 - DNA, 16 bp, Artificial sequence
  Synthetic oligonucleotide
ggcggagcggaaacag

SEQ ID NO: 3261 - DNA, 16 bp, Artificial sequence
  Synthetic oligonucleotide
ctctctcgcagcaagc

SEQ ID NO: 3262 - DNA, 16 bp, Artificial sequence
  Synthetic oligonucleotide
caccccatctgacaac

SEQ ID NO: 3263 - DNA, 16 bp, Artificial sequence
  Synthetic oligonucleotide
aaccgggctaagagct

SEQ ID NO: 3264 - DNA, 16 bp, Artificial sequence
  Synthetic oligonucleotide
tgggtcggaaacacgc

SEQ ID NO: 3265 - DNA, 16 bp, Artificial sequence
  Synthetic oligonucleotide
ccgtccgttggtccag

SEQ ID NO: 3266 - DNA, 16 bp, Artificial sequence
  Synthetic oligonucleotide
tggaatcgaaagtgtt

SEQ ID NO: 3267 - DNA, 16 bp, Artificial sequence
  Synthetic oligonucleotide
actgtgtgctcttcag

SEQ ID NO: 3268 - DNA, 16 bp, Artificial sequence
  Synthetic oligonucleotide
ctccccggtgacagtg

SEQ ID NO: 3269 - DNA, 16 bp, Artificial sequence
  Synthetic oligonucleotide
ggtacatttgtggtac

SEQ ID NO: 3270 - DNA, 16 bp, Artificial sequence
  Synthetic oligonucleotide
tcctgatcaaagttgg

SEQ ID NO: 3271 - DNA, 16 bp, Artificial sequence
  Synthetic oligonucleotide
ctgcagtggtctttca

SEQ ID NO: 3272 - DNA, 16 bp, Artificial sequence
  Synthetic oligonucleotide
aaaaccggagaagctg

SEQ ID NO: 3273 - DNA, 16 bp, Artificial sequence
  Synthetic oligonucleotide
atcaggacccttgcac

SEQ ID NO: 3274 - DNA, 16 bp, Artificial sequence
  Synthetic oligonucleotide
ggaggcacgggttggt

SEQ ID NO: 3275 - DNA, 16 bp, Artificial sequence
  Synthetic oligonucleotide
tccacctctaggcagc

SEQ ID NO: 3276 - DNA, 16 bp, Artificial sequence
  Synthetic oligonucleotide
tccggtgtagcccacc

SEQ ID NO: 3277 - DNA, 16 bp, Artificial sequence
  Synthetic oligonucleotide
gcggccatcatagcag

SEQ ID NO: 3278 - DNA, 16 bp, Artificial sequence
  Synthetic oligonucleotide
gacagggcgcacccga

SEQ ID NO: 3279 - DNA, 16 bp, Artificial sequence
  Synthetic oligonucleotide
ttccggtaggtggcct

SEQ ID NO: 3280 - DNA, 16 bp, Artificial sequence
  Synthetic oligonucleotide
ggttccggcagaaggc

SEQ ID NO: 3281 - DNA, 16 bp, Artificial sequence
  Synthetic oligonucleotide
cgcggttcagcacgaa

SEQ ID NO: 3282 - DNA, 16 bp, Artificial sequence
  Synthetic oligonucleotide
gcgccgcctgggttgg

SEQ ID NO: 3283 - DNA, 16 bp, Artificial sequence
  Synthetic oligonucleotide
ttcggcggtgccggct

SEQ ID NO: 3284 - DNA, 16 bp, Artificial sequence
  Synthetic oligonucleotide
cccgcttcgccggcaa

SEQ ID NO: 3285 - DNA, 16 bp, Artificial sequence
  Synthetic oligonucleotide
gcccgcagctcagtgg

SEQ ID NO: 3286 - DNA, 16 bp, Artificial sequence
  Synthetic oligonucleotide
cgaagacagactcttg

SEQ ID NO: 3287 - DNA, 16 bp, Artificial sequence
  Synthetic oligonucleotide
cagcccgccaacgacg

SEQ ID NO: 3288 - DNA, 16 bp, Artificial sequence
  Synthetic oligonucleotide
gcgcagaaactgtggc

SEQ ID NO: 3289 - DNA, 16 bp, Artificial sequence
  Synthetic oligonucleotide
agatcctcgggtgcgg

SEQ ID NO: 3290 - DNA, 16 bp, Artificial sequence
  Synthetic oligonucleotide
taggagcgcacggcca

SEQ ID NO: 3291 - DNA, 16 bp, Artificial sequence
  Synthetic oligonucleotide
gctggtagctgacggg

SEQ ID NO: 3292 - DNA, 16 bp, Artificial sequence
  Synthetic oligonucleotide
ccgtccgcatcctcct

SEQ ID NO: 3293 - DNA, 16 bp, Artificial sequence
  Synthetic oligonucleotide
aaggcgacaggagcgc

SEQ ID NO: 3294 - DNA, 16 bp, Artificial sequence
  Synthetic oligonucleotide
ctcggagggtcgcgcg

SEQ ID NO: 3295 - DNA, 16 bp, Artificial sequence
  Synthetic oligonucleotide
gccccctcgaactggt

SEQ ID NO: 3296 - DNA, 16 bp, Artificial sequence
  Synthetic oligonucleotide
acggtacctgcgcctc

SEQ ID NO: 3297 - DNA, 16 bp, Artificial sequence
  Synthetic oligonucleotide
tgcgcagagcatgccg

SEQ ID NO: 3298 - DNA, 16 bp, Artificial sequence
  Synthetic oligonucleotide
gcatcggtgccgccct

SEQ ID NO: 3299 - DNA, 16 bp, Artificial sequence
  Synthetic oligonucleotide
tgcagggtgagccggc

SEQ ID NO: 3300 - DNA, 16 bp, Artificial sequence
  Synthetic oligonucleotide
cttgttgcggtcacca

SEQ ID NO: 3301 - DNA, 16 bp, Artificial sequence
  Synthetic oligonucleotide
ggtagtaggccacatc

SEQ ID NO: 3302 - DNA, 16 bp, Artificial sequence
  Synthetic oligonucleotide
aatcaggaaacggtgt

SEQ ID NO: 3303 - DNA, 16 bp, Artificial sequence
  Synthetic oligonucleotide
cggaatcaccaaggag

SEQ ID NO: 3304 - DNA, 16 bp, Artificial sequence
  Synthetic oligonucleotide
acaatcttgccttcca

SEQ ID NO: 3305 - DNA, 16 bp, Artificial sequence
  Synthetic oligonucleotide
tgcgccatcctggcgc

SEQ ID NO: 3306 - DNA, 16 bp, Artificial sequence
  Synthetic oligonucleotide
caaagcactttattga

SEQ ID NO: 3307 - DNA, 16 bp, Artificial sequence
  Synthetic oligonucleotide
tagcgaccccccagaa

SEQ ID NO: 3308 - DNA, 16 bp, Artificial sequence
  Synthetic oligonucleotide
gtatccacccagtctg

SEQ ID NO: 3309 - DNA, 16 bp, Artificial sequence
  Synthetic oligonucleotide
gcctgccaccgatctg

SEQ ID NO: 3310 - DNA, 16 bp, Artificial sequence
  Synthetic oligonucleotide
caggccacttaccgac

SEQ ID NO: 3311 - DNA, 16 bp, Artificial sequence
  Synthetic oligonucleotide
taagacctagcaccag

SEQ ID NO: 3312 - DNA, 16 bp, Artificial sequence
  Synthetic oligonucleotide
cgtgggcacttagaca

SEQ ID NO: 3313 - DNA, 16 bp, Artificial sequence
  Synthetic oligonucleotide
atcaacctggtttcac

SEQ ID NO: 3314 - DNA, 16 bp, Artificial sequence
  Synthetic oligonucleotide
gtaatttagtgtctgg

SEQ ID NO: 3315 - DNA, 16 bp, Artificial sequence
  Synthetic oligonucleotide
gcttagagactcaacc

SEQ ID NO: 3316 - DNA, 16 bp, Artificial sequence
  Synthetic oligonucleotide
tggacctttaagatgc

SEQ ID NO: 3317 - DNA, 16 bp, Artificial sequence
  Synthetic oligonucleotide
acataaccatcgcgaa

SEQ ID NO: 3318 - DNA, 16 bp, Artificial sequence
  Synthetic oligonucleotide
cgtgtgttagacactt

SEQ ID NO: 3319 - DNA, 16 bp, Artificial sequence
  Synthetic oligonucleotide
tctcctattgaatgag

SEQ ID NO: 3320 - DNA, 16 bp, Artificial sequence
  Synthetic oligonucleotide
ggagtagactcctgac

SEQ ID NO: 3321 - DNA, 16 bp, Artificial sequence
  Synthetic oligonucleotide
ctcaaaaaggtcgctg

SEQ ID NO: 3322 - DNA, 16 bp, Artificial sequence
  Synthetic oligonucleotide
tggtgataccaggaga

SEQ ID NO: 3323 - DNA, 16 bp, Artificial sequence
  Synthetic oligonucleotide
cccttcttgaacctac

SEQ ID NO: 3324 - DNA, 16 bp, Artificial sequence
  Synthetic oligonucleotide
tgccaagtctccgagt

SEQ ID NO: 3325 - DNA, 16 bp, Artificial sequence
  Synthetic oligonucleotide
tggcacaccacccggc

SEQ ID NO: 3326 - DNA, 16 bp, Artificial sequence
  Synthetic oligonucleotide
tggcaagcccgtccca

SEQ ID NO: 3327 - DNA, 16 bp, Artificial sequence
  Synthetic oligonucleotide
cctgtagccacacgac

SEQ ID NO: 3328 - DNA, 16 bp, Artificial sequence
  Synthetic oligonucleotide
ccggctggccggaatc

SEQ ID NO: 3329 - DNA, 16 bp, Artificial sequence
  Synthetic oligonucleotide
tactcgccggtcctgc

SEQ ID NO: 3330 - DNA, 16 bp, Artificial sequence
  Synthetic oligonucleotide
cccgggagctccggag

SEQ ID NO: 3331 - DNA, 16 bp, Artificial sequence
  Synthetic oligonucleotide
acccgggcggagagga

SEQ ID NO: 3332 - DNA, 16 bp, Artificial sequence
  Synthetic oligonucleotide
cctaccctcgaactgg

SEQ ID NO: 3333 - DNA, 16 bp, Artificial sequence
  Synthetic oligonucleotide
gcgggcttcttccgcc

SEQ ID NO: 3334 - DNA, 16 bp, Artificial sequence
  Synthetic oligonucleotide
cccggaacgataccaa

SEQ ID NO: 3335 - DNA, 16 bp, Artificial sequence
  Synthetic oligonucleotide
cgattctccctgtatc

SEQ ID NO: 3336 - DNA, 16 bp, Artificial sequence
  Synthetic oligonucleotide
actagcccggagcgcg

SEQ ID NO: 3337 - DNA, 16 bp, Artificial sequence
  Synthetic oligonucleotide
gggcggagcggaaaca

SEQ ID NO: 3338 - DNA, 16 bp, Artificial sequence
  Synthetic oligonucleotide
gtaaacccactcatgc

SEQ ID NO: 3339 - DNA, 16 bp, Artificial sequence
  Synthetic oligonucleotide
tcacaccccatctgac

SEQ ID NO: 3340 - DNA, 16 bp, Artificial sequence
  Synthetic oligonucleotide
caaccgggctaagagc

SEQ ID NO: 3341 - DNA, 16 bp, Artificial sequence
  Synthetic oligonucleotide
ctgggtcggaaacacg

SEQ ID NO: 3342 - DNA, 16 bp, Artificial sequence
  Synthetic oligonucleotide
gtggaatcgaaagtgt

SEQ ID NO: 3343 - DNA, 16 bp, Artificial sequence
  Synthetic oligonucleotide
gactgtgtgctcttca

SEQ ID NO: 3344 - DNA, 16 bp, Artificial sequence
  Synthetic oligonucleotide
gctccccggtgacagt

SEQ ID NO: 3345 - DNA, 16 bp, Artificial sequence
  Synthetic oligonucleotide
gggtacatttgtggta

SEQ ID NO: 3346 - DNA, 16 bp, Artificial sequence
  Synthetic oligonucleotide
gctggtcctgatcaaa

SEQ ID NO: 3347 - DNA, 16 bp, Artificial sequence
  Synthetic oligonucleotide
cacaggtccctccttt

SEQ ID NO: 3348 - DNA, 16 bp, Artificial sequence
  Synthetic oligonucleotide
aaaaaccggagaagct

SEQ ID NO: 3349 - DNA, 16 bp, Artificial sequence
  Synthetic oligonucleotide
catcaggacccttgca

SEQ ID NO: 3350 - DNA, 16 bp, Artificial sequence
  Synthetic oligonucleotide
atggaggcacgggttg

SEQ ID NO: 3351 - DNA, 16 bp, Artificial sequence
  Synthetic oligonucleotide
gtggccctccacctct

SEQ ID NO: 3352 - DNA, 16 bp, Artificial sequence
  Synthetic oligonucleotide
ctccggtgtagcccac

SEQ ID NO: 3353 - DNA, 16 bp, Artificial sequence
  Synthetic oligonucleotide
cgcggccatcatagca

SEQ ID NO: 3354 - DNA, 16 bp, Artificial sequence
  Synthetic oligonucleotide
tgacagggcgcacccg

SEQ ID NO: 3355 - DNA, 16 bp, Artificial sequence
  Synthetic oligonucleotide
gttccggtaggtggcc

SEQ ID NO: 3356 - DNA, 16 bp, Artificial sequence
  Synthetic oligonucleotide
gggttccggcagaagg

SEQ ID NO: 3357 - DNA, 16 bp, Artificial sequence
  Synthetic oligonucleotide
tcgcggttcagcacga

SEQ ID NO: 3358 - DNA, 16 bp, Artificial sequence
  Synthetic oligonucleotide
gacatgaagcctaggg

SEQ ID NO: 3359 - DNA, 16 bp, Artificial sequence
  Synthetic oligonucleotide
cttcggcggtgccggc

SEQ ID NO: 3360 - DNA, 16 bp, Artificial sequence
  Synthetic oligonucleotide
tcccgcttcgccggca

SEQ ID NO: 3361 - DNA, 16 bp, Artificial sequence
  Synthetic oligonucleotide
ctgcccgcagctcagt

SEQ ID NO: 3362 - DNA, 16 bp, Artificial sequence
  Synthetic oligonucleotide
tcgaagacagactctt

SEQ ID NO: 3363 - DNA, 16 bp, Artificial sequence
  Synthetic oligonucleotide
caccagcccgccaacg

SEQ ID NO: 3364 - DNA, 16 bp, Artificial sequence
  Synthetic oligonucleotide
ggcgcagaaactgtgg

SEQ ID NO: 3365 - DNA, 16 bp, Artificial sequence
  Synthetic oligonucleotide
tcagatcctcgggtgc

SEQ ID NO: 3366 - DNA, 16 bp, Artificial sequence
  Synthetic oligonucleotide
gtaggagcgcacggcc

SEQ ID NO: 3367 - DNA, 16 bp, Artificial sequence
  Synthetic oligonucleotide
tgctggtagctgacgg

SEQ ID NO: 3368 - DNA, 16 bp, Artificial sequence
  Synthetic oligonucleotide
tgccgtccgcatcctc

SEQ ID NO: 3369 - DNA, 16 bp, Artificial sequence
  Synthetic oligonucleotide
taaggcgacaggagcg

SEQ ID NO: 3370 - DNA, 16 bp, Artificial sequence
  Synthetic oligonucleotide
tctcggagggtcgcgc

SEQ ID NO: 3371 - DNA, 16 bp, Artificial sequence
  Synthetic oligonucleotide
cgccccctcgaactgg

SEQ ID NO: 3372 - DNA, 16 bp, Artificial sequence
  Synthetic oligonucleotide
aacggtacctgcgcct

SEQ ID NO: 3373 - DNA, 16 bp, Artificial sequence
  Synthetic oligonucleotide
ccctgcgcagagcatg

SEQ ID NO: 3374 - DNA, 16 bp, Artificial sequence
  Synthetic oligonucleotide
cgcatcggtgccgccc

SEQ ID NO: 3375 - DNA, 16 bp, Artificial sequence
  Synthetic oligonucleotide
ttgcagggtgagccgg

SEQ ID NO: 3376 - DNA, 16 bp, Artificial sequence
  Synthetic oligonucleotide
gcttgttgcggtcacc

SEQ ID NO: 3377 - DNA, 16 bp, Artificial sequence
  Synthetic oligonucleotide
aggtagtaggccacat

SEQ ID NO: 3378 - DNA, 16 bp, Artificial sequence
  Synthetic oligonucleotide
caatcaggaaacggtg

SEQ ID NO: 3379 - DNA, 16 bp, Artificial sequence
  Synthetic oligonucleotide
gcggaatcaccaagga

SEQ ID NO: 3380 - DNA, 16 bp, Artificial sequence
  Synthetic oligonucleotide
ggacacaatcttgcct

SEQ ID NO: 3381 - DNA, 16 bp, Artificial sequence
  Synthetic oligonucleotide
ctgcgccatcctggcg

SEQ ID NO: 3382 - DNA, 16 bp, Artificial sequence
  Synthetic oligonucleotide
tcaaagcactttattg

SEQ ID NO: 3383 - DNA, 16 bp, Artificial sequence
  Synthetic oligonucleotide
atagcgaccccccaga

SEQ ID NO: 3384 - DNA, 16 bp, Artificial sequence
  Synthetic oligonucleotide
ttgtatccacccagtc

SEQ ID NO: 3385 - DNA, 16 bp, Artificial sequence
  Synthetic oligonucleotide
tcatagcctgccaccg

SEQ ID NO: 3386 - DNA, 16 bp, Artificial sequence
  Synthetic oligonucleotide
acccaagggttcccgg

SEQ ID NO: 3387 - DNA, 16 bp, Artificial sequence
  Synthetic oligonucleotide
gcataagacctagcac

SEQ ID NO: 3388 - DNA, 16 bp, Artificial sequence
  Synthetic oligonucleotide
aagcacctgctccgag

SEQ ID NO: 3389 - DNA, 16 bp, Artificial sequence
  Synthetic oligonucleotide
ctgttatcaacctggt

SEQ ID NO: 3390 - DNA, 16 bp, Artificial sequence
  Synthetic oligonucleotide
ggtaatttagtgtctg

SEQ ID NO: 3391 - DNA, 16 bp, Artificial sequence
  Synthetic oligonucleotide
tgcttagagactcaac

SEQ ID NO: 3392 - DNA, 16 bp, Artificial sequence
  Synthetic oligonucleotide
gatggacctttaagat

SEQ ID NO: 3393 - DNA, 16 bp, Artificial sequence
  Synthetic oligonucleotide
aacataaccatcgcga

SEQ ID NO: 3394 - DNA, 16 bp, Artificial sequence
  Synthetic oligonucleotide
ccttagggagaaagcg

SEQ ID NO: 3395 - DNA, 16 bp, Artificial sequence
  Synthetic oligonucleotide
agctctcctattgaat

SEQ ID NO: 3396 - DNA, 16 bp, Artificial sequence
  Synthetic oligonucleotide
ctggagtagactcctg

SEQ ID NO: 3397 - DNA, 16 bp, Artificial sequence
  Synthetic oligonucleotide
cctcaaaaaggtcgct

SEQ ID NO: 3398 - DNA, 16 bp, Artificial sequence
  Synthetic oligonucleotide
gtctggtgataccagg

SEQ ID NO: 3399 - DNA, 16 bp, Artificial sequence
  Synthetic oligonucleotide
aggcccttcttgaacc

SEQ ID NO: 3400 - DNA, 16 bp, Artificial sequence
  Synthetic oligonucleotide
atgccaagtctccgag

SEQ ID NO: 3401 - DNA, 16 bp, Artificial sequence
  Synthetic oligonucleotide
ctggcacaccacccgg

SEQ ID NO: 3402 - DNA, 16 bp, Artificial sequence
  Synthetic oligonucleotide
ctggcaagcccgtccc

SEQ ID NO: 3403 - DNA, 16 bp, Artificial sequence
  Synthetic oligonucleotide
tcctgtagccacacga

SEQ ID NO: 3404 - DNA, 16 bp, Artificial sequence
  Synthetic oligonucleotide
gccggctggccggaat

SEQ ID NO: 3405 - DNA, 16 bp, Artificial sequence
  Synthetic oligonucleotide
gtactcgccggtcctg

SEQ ID NO: 3406 - DNA, 16 bp, Artificial sequence
  Synthetic oligonucleotide
ccccgggagctccgga

SEQ ID NO: 3407 - DNA, 16 bp, Artificial sequence
  Synthetic oligonucleotide
aacccgggcggagagg

SEQ ID NO: 3408 - DNA, 16 bp, Artificial sequence
  Synthetic oligonucleotide
gcctaccctcgaactg

SEQ ID NO: 3409 - DNA, 16 bp, Artificial sequence
  Synthetic oligonucleotide
cgcgggcttcttccgc

SEQ ID NO: 3410 - DNA, 16 bp, Artificial sequence
  Synthetic oligonucleotide
acccggaacgatacca

SEQ ID NO: 3411 - DNA, 16 bp, Artificial sequence
  Synthetic oligonucleotide
ttcgattctccctgta

SEQ ID NO: 3412 - DNA, 16 bp, Artificial sequence
  Synthetic oligonucleotide
cactagcccggagcgc

SEQ ID NO: 3413 - DNA, 16 bp, Artificial sequence
  Synthetic oligonucleotide
tgggcggagcggaaac

SEQ ID NO: 3414 - DNA, 16 bp, Artificial sequence
  Synthetic oligonucleotide
ttgtaaacccactcat

SEQ ID NO: 3415 - DNA, 16 bp, Artificial sequence
  Synthetic oligonucleotide
tgcgaacacagagcgc

SEQ ID NO: 3416 - DNA, 16 bp, Artificial sequence
  Synthetic oligonucleotide
ccaaccgggctaagag

SEQ ID NO: 3417 - DNA, 16 bp, Artificial sequence
  Synthetic oligonucleotide
cctgggtcggaaacac

SEQ ID NO: 3418 - DNA, 16 bp, Artificial sequence
  Synthetic oligonucleotide
ggtggaatcgaaagtg

SEQ ID NO: 3419 - DNA, 16 bp, Artificial sequence
  Synthetic oligonucleotide
cgactgtgtgctcttc

SEQ ID NO: 3420 - DNA, 16 bp, Artificial sequence
  Synthetic oligonucleotide
ggctccccggtgacag

SEQ ID NO: 3421 - DNA, 16 bp, Artificial sequence
  Synthetic oligonucleotide
tgggtacatttgtggt

SEQ ID NO: 3422 - DNA, 16 bp, Artificial sequence
  Synthetic oligonucleotide
cgctggtcctgatcaa

SEQ ID NO: 3423 - DNA, 16 bp, Artificial sequence
  Synthetic oligonucleotide
acacaggtccctcctt

SEQ ID NO: 3424 - DNA, 16 bp, Artificial sequence
  Synthetic oligonucleotide
gaaaaaccggagaagc

SEQ ID NO: 3425 - DNA, 16 bp, Artificial sequence
  Synthetic oligonucleotide
gcatcaggacccttgc

SEQ ID NO: 3426 - DNA, 16 bp, Artificial sequence
  Synthetic oligonucleotide
catggaggcacgggtt

SEQ ID NO: 3427 - DNA, 16 bp, Artificial sequence
  Synthetic oligonucleotide
ggcggtggccctccac

SEQ ID NO: 3428 - DNA, 16 bp, Artificial sequence
  Synthetic oligonucleotide
gctccggtgtagccca

SEQ ID NO: 3429 - DNA, 16 bp, Artificial sequence
  Synthetic oligonucleotide
ccgcggccatcatagc

SEQ ID NO: 3430 - DNA, 16 bp, Artificial sequence
  Synthetic oligonucleotide
ctgacagggcgcaccc

SEQ ID NO: 3431 - DNA, 16 bp, Artificial sequence
  Synthetic oligonucleotide
cgcttgctcggcagtc

SEQ ID NO: 3432 - DNA, 16 bp, Artificial sequence
  Synthetic oligonucleotide
cgggttccggcagaag

SEQ ID NO: 3433 - DNA, 16 bp, Artificial sequence
  Synthetic oligonucleotide
gtcgcggttcagcacg

SEQ ID NO: 3434 - DNA, 16 bp, Artificial sequence
  Synthetic oligonucleotide
ggacatgaagcctagg

SEQ ID NO: 3435 - DNA, 16 bp, Artificial sequence
  Synthetic oligonucleotide
gcttcggcggtgccgg

SEQ ID NO: 3436 - DNA, 16 bp, Artificial sequence
  Synthetic oligonucleotide
gctcccgcttcgccgg

SEQ ID NO: 3437 - DNA, 16 bp, Artificial sequence
  Synthetic oligonucleotide
cgctgcccgcagctca

SEQ ID NO: 3438 - DNA, 16 bp, Artificial sequence
  Synthetic oligonucleotide
atcgaagacagactct

SEQ ID NO: 3439 - DNA, 16 bp, Artificial sequence
  Synthetic oligonucleotide
cgccaccagcccgcca

SEQ ID NO: 3440 - DNA, 16 bp, Artificial sequence
  Synthetic oligonucleotide
cggcgcagaaactgtg

SEQ ID NO: 3441 - DNA, 16 bp, Artificial sequence
  Synthetic oligonucleotide
cgtcagatcctcgggt

SEQ ID NO: 3442 - DNA, 16 bp, Artificial sequence
  Synthetic oligonucleotide
cggtaggagcgcacgg

SEQ ID NO: 3443 - DNA, 16 bp, Artificial sequence
  Synthetic oligonucleotide
caacagagccaggtcg

SEQ ID NO: 3444 - DNA, 16 bp, Artificial sequence
  Synthetic oligonucleotide
ctgccgtccgcatcct

SEQ ID NO: 3445 - DNA, 16 bp, Artificial sequence
  Synthetic oligonucleotide
gtaaggcgacaggagc

SEQ ID NO: 3446 - DNA, 16 bp, Artificial sequence
  Synthetic oligonucleotide
gtctcggagggtcgcg

SEQ ID NO: 3447 - DNA, 16 bp, Artificial sequence
  Synthetic oligonucleotide
ccgccccctcgaactg

SEQ ID NO: 3448 - DNA, 16 bp, Artificial sequence
  Synthetic oligonucleotide
gaacggtacctgcgcc

SEQ ID NO: 3449 - DNA, 16 bp, Artificial sequence
  Synthetic oligonucleotide
accctgcgcagagcat

SEQ ID NO: 3450 - DNA, 16 bp, Artificial sequence
  Synthetic oligonucleotide
acgcatcggtgccgcc

SEQ ID NO: 3451 - DNA, 16 bp, Artificial sequence
  Synthetic oligonucleotide
gccttgcagggtgagc

SEQ ID NO: 3452 - DNA, 16 bp, Artificial sequence
  Synthetic oligonucleotide
ggcttgttgcggtcac

SEQ ID NO: 3453 - DNA, 16 bp, Artificial sequence
  Synthetic oligonucleotide
caggtagtaggccaca

SEQ ID NO: 3454 - DNA, 16 bp, Artificial sequence
  Synthetic oligonucleotide
gagcaatcaggaaacg

SEQ ID NO: 3455 - DNA, 16 bp, Artificial sequence
  Synthetic oligonucleotide
tgcggaatcaccaagg

SEQ ID NO: 3456 - DNA, 16 bp, Artificial sequence
  Synthetic oligonucleotide
tgggacacaatcttgc

SEQ ID NO: 3457 - DNA, 16 bp, Artificial sequence
  Synthetic oligonucleotide
cctgcgccatcctggc

SEQ ID NO: 3458 - DNA, 16 bp, Artificial sequence
  Synthetic oligonucleotide
agcattttcaaagcac

SEQ ID NO: 3459 - DNA, 16 bp, Artificial sequence
  Synthetic oligonucleotide
gatagcgaccccccag

SEQ ID NO: 3460 - DNA, 16 bp, Artificial sequence
  Synthetic oligonucleotide
gcccttgtatccaccc

SEQ ID NO: 3461 - DNA, 16 bp, Artificial sequence
  Synthetic oligonucleotide
agtcatagcctgccac

SEQ ID NO: 3462 - DNA, 16 bp, Artificial sequence
  Synthetic oligonucleotide
cacccaagggttcccg

SEQ ID NO: 3463 - DNA, 16 bp, Artificial sequence
  Synthetic oligonucleotide
ggcataagacctagca

SEQ ID NO: 3464 - DNA, 16 bp, Artificial sequence
  Synthetic oligonucleotide
tcaagcacctgctccg

SEQ ID NO: 3465 - DNA, 16 bp, Artificial sequence
  Synthetic oligonucleotide
actgttatcaacctgg

SEQ ID NO: 3466 - DNA, 16 bp, Artificial sequence
  Synthetic oligonucleotide
taggtaatttagtgtc

SEQ ID NO: 3467 - DNA, 16 bp, Artificial sequence
  Synthetic oligonucleotide
catgcttagagactca

SEQ ID NO: 3468 - DNA, 16 bp, Artificial sequence
  Synthetic oligonucleotide
ggatctgagatggacc

SEQ ID NO: 3469 - DNA, 16 bp, Artificial sequence
  Synthetic oligonucleotide
gaacataaccatcgcg

SEQ ID NO: 3470 - DNA, 16 bp, Artificial sequence
  Synthetic oligonucleotide
aggctaccttagggag

SEQ ID NO: 3471 - DNA, 16 bp, Artificial sequence
  Synthetic oligonucleotide
cgtcacgctgctgctg

SEQ ID NO: 3472 - DNA, 16 bp, Artificial sequence
  Synthetic oligonucleotide
gctggagtagactcct

SEQ ID NO: 3473 - DNA, 16 bp, Artificial sequence
  Synthetic oligonucleotide
ccctcaaaaaggtcgc

SEQ ID NO: 3474 - DNA, 16 bp, Artificial sequence
  Synthetic oligonucleotide
caaagggtattgtgga

SEQ ID NO: 3475 - DNA, 16 bp, Artificial sequence
  Synthetic oligonucleotide
ctattctgtaggccca

SEQ ID NO: 3476 - DNA, 16 bp, Artificial sequence
  Synthetic oligonucleotide
gtctaggaccatgcca

SEQ ID NO: 3477 - DNA, 16 bp, Artificial sequence
  Synthetic oligonucleotide
acccccccagagagct

SEQ ID NO: 3478 - DNA, 16 bp, Artificial sequence
  Synthetic oligonucleotide
tcctggcaagcccgtc

SEQ ID NO: 3479 - DNA, 16 bp, Artificial sequence
  Synthetic oligonucleotide
tccgggttcctgtagc

SEQ ID NO: 3480 - DNA, 16 bp, Artificial sequence
  Synthetic oligonucleotide
cggccggctggccgga

SEQ ID NO: 3481 - DNA, 16 bp, Artificial sequence
  Synthetic oligonucleotide
ggtactcgccggtcct

SEQ ID NO: 3482 - DNA, 16 bp, Artificial sequence
  Synthetic oligonucleotide
tccccgggagctccgg

SEQ ID NO: 3483 - DNA, 16 bp, Artificial sequence
  Synthetic oligonucleotide
taacccgggcggagag

SEQ ID NO: 3484 - DNA, 16 bp, Artificial sequence
  Synthetic oligonucleotide
tgcctaccctcgaact

SEQ ID NO: 3485 - DNA, 16 bp, Artificial sequence
  Synthetic oligonucleotide
tcgcgggcttcttccg

SEQ ID NO: 3486 - DNA, 16 bp, Artificial sequence
  Synthetic oligonucleotide
cacccggaacgatacc

SEQ ID NO: 3487 - DNA, 16 bp, Artificial sequence
  Synthetic oligonucleotide
agttcgattctccctg

SEQ ID NO: 3488 - DNA, 16 bp, Artificial sequence
  Synthetic oligonucleotide
acactagcccggagcg

SEQ ID NO: 3489 - DNA, 16 bp, Artificial sequence
  Synthetic oligonucleotide
atgggcggagcggaaa

SEQ ID NO: 3490 - DNA, 16 bp, Artificial sequence
  Synthetic oligonucleotide
cttgtaaacccactca

SEQ ID NO: 3491 - DNA, 16 bp, Artificial sequence
  Synthetic oligonucleotide
ctgcgaacacagagcg

SEQ ID NO: 3492 - DNA, 16 bp, Artificial sequence
  Synthetic oligonucleotide
gccaaccgggctaaga

SEQ ID NO: 3493 - DNA, 16 bp, Artificial sequence
  Synthetic oligonucleotide
ccctgggtcggaaaca

SEQ ID NO: 3494 - DNA, 16 bp, Artificial sequence
  Synthetic oligonucleotide
aaggtggaatcgaaag

SEQ ID NO: 3495 - DNA, 16 bp, Artificial sequence
  Synthetic oligonucleotide
acgactgtgtgctctt

SEQ ID NO: 3496 - DNA, 16 bp, Artificial sequence
  Synthetic oligonucleotide
gcagggctccccggtg

SEQ ID NO: 3497 - DNA, 16 bp, Artificial sequence
  Synthetic oligonucleotide
gtgggtacatttgtgg

SEQ ID NO: 3498 - DNA, 16 bp, Artificial sequence
  Synthetic oligonucleotide
atcgctggtcctgatc

SEQ ID NO: 3499 - DNA, 16 bp, Artificial sequence
  Synthetic oligonucleotide
gttcacacaggtccct

SEQ ID NO: 3500 - DNA, 16 bp, Artificial sequence
  Synthetic oligonucleotide
ggaaaaaccggagaag

SEQ ID NO: 3501 - DNA, 16 bp, Artificial sequence
  Synthetic oligonucleotide
ggcatcaggacccttg

SEQ ID NO: 3502 - DNA, 16 bp, Artificial sequence
  Synthetic oligonucleotide
ccatggaggcacgggt

SEQ ID NO: 3503 - DNA, 16 bp, Artificial sequence
  Synthetic oligonucleotide
aggcggtggccctcca

SEQ ID NO: 3504 - DNA, 16 bp, Artificial sequence
  Synthetic oligonucleotide
ggctccggtgtagccc

SEQ ID NO: 3505 - DNA, 16 bp, Artificial sequence
  Synthetic oligonucleotide
cccgcggccatcatag

SEQ ID NO: 3506 - DNA, 16 bp, Artificial sequence
  Synthetic oligonucleotide
gctgacagggcgcacc

SEQ ID NO: 3507 - DNA, 16 bp, Artificial sequence
  Synthetic oligonucleotide
cgcgcttgctcggcag

SEQ ID NO: 3508 - DNA, 16 bp, Artificial sequence
  Synthetic oligonucleotide
ccgggttccggcagaa

SEQ ID NO: 3509 - DNA, 16 bp, Artificial sequence
  Synthetic oligonucleotide
ggtcgcggttcagcac

SEQ ID NO: 3510 - DNA, 16 bp, Artificial sequence
  Synthetic oligonucleotide
tgggacatgaagccta

SEQ ID NO: 3511 - DNA, 16 bp, Artificial sequence
  Synthetic oligonucleotide
ggcttcggcggtgccg

SEQ ID NO: 3512 - DNA, 16 bp, Artificial sequence
  Synthetic oligonucleotide
gcggctgctcccgctt

SEQ ID NO: 3513 - DNA, 16 bp, Artificial sequence
  Synthetic oligonucleotide
gccgctgcccgcagct

SEQ ID NO: 3514 - DNA, 16 bp, Artificial sequence
  Synthetic oligonucleotide
catcgaagacagactc

SEQ ID NO: 3515 - DNA, 16 bp, Artificial sequence
  Synthetic oligonucleotide
gcgcggcgatgtaggg

SEQ ID NO: 3516 - DNA, 16 bp, Artificial sequence
  Synthetic oligonucleotide
ccggcgcagaaactgt

SEQ ID NO: 3517 - DNA, 16 bp, Artificial sequence
  Synthetic oligonucleotide
caccgtcagatcctcg

SEQ ID NO: 3518 - DNA, 16 bp, Artificial sequence
  Synthetic oligonucleotide
gcggtaggagcgcacg

SEQ ID NO: 3519 - DNA, 16 bp, Artificial sequence
  Synthetic oligonucleotide
cgcaacagagccaggt

SEQ ID NO: 3520 - DNA, 16 bp, Artificial sequence
  Synthetic oligonucleotide
gctgccgtccgcatcc

SEQ ID NO: 3521 - DNA, 16 bp, Artificial sequence
  Synthetic oligonucleotide
cgtaaggcgacaggag

SEQ ID NO: 3522 - DNA, 16 bp, Artificial sequence
  Synthetic oligonucleotide
ggtctcggagggtcgc

SEQ ID NO: 3523 - DNA, 16 bp, Artificial sequence
  Synthetic oligonucleotide
tccgccccctcgaact

SEQ ID NO: 3524 - DNA, 16 bp, Artificial sequence
  Synthetic oligonucleotide
ggaacggtacctgcgc

SEQ ID NO: 3525 - DNA, 16 bp, Artificial sequence
  Synthetic oligonucleotide
aaccctgcgcagagca

SEQ ID NO: 3526 - DNA, 16 bp, Artificial sequence
  Synthetic oligonucleotide
cacgcatcggtgccgc

SEQ ID NO: 3527 - DNA, 16 bp, Artificial sequence
  Synthetic oligonucleotide
tgccttgcagggtgag

SEQ ID NO: 3528 - DNA, 16 bp, Artificial sequence
  Synthetic oligonucleotide
tggcttgttgcggtca

SEQ ID NO: 3529 - DNA, 16 bp, Artificial sequence
  Synthetic oligonucleotide
ccaggtagtaggccac

SEQ ID NO: 3530 - DNA, 16 bp, Artificial sequence
  Synthetic oligonucleotide
ccctgagcaatcagga

SEQ ID NO: 3531 - DNA, 16 bp, Artificial sequence
  Synthetic oligonucleotide
ctgcggaatcaccaag

SEQ ID NO: 3532 - DNA, 16 bp, Artificial sequence
  Synthetic oligonucleotide
atgggacacaatcttg

SEQ ID NO: 3533 - DNA, 16 bp, Artificial sequence
  Synthetic oligonucleotide
tcctgcgccatcctgg

SEQ ID NO: 3534 - DNA, 16 bp, Artificial sequence
  Synthetic oligonucleotide
tcagcattttcaaagc

SEQ ID NO: 3535 - DNA, 16 bp, Artificial sequence
  Synthetic oligonucleotide
tgatagcgacccccca

SEQ ID NO: 3536 - DNA, 16 bp, Artificial sequence
  Synthetic oligonucleotide
gtgcccttgtatccac

SEQ ID NO: 3537 - DNA, 16 bp, Artificial sequence
  Synthetic oligonucleotide
aagtcatagcctgcca

SEQ ID NO: 3538 - DNA, 16 bp, Artificial sequence
  Synthetic oligonucleotide
gcaccatacacatccc

SEQ ID NO: 3539 - DNA, 16 bp, Artificial sequence
  Synthetic oligonucleotide
gggcataagacctagc

SEQ ID NO: 3540 - DNA, 16 bp, Artificial sequence
  Synthetic oligonucleotide
gcacatatctcaagca

SEQ ID NO: 3541 - DNA, 16 bp, Artificial sequence
  Synthetic oligonucleotide
gaggtttactgttatc

SEQ ID NO: 3542 - DNA, 16 bp, Artificial sequence
  Synthetic oligonucleotide
gtaggtaatttagtgt

SEQ ID NO: 3543 - DNA, 16 bp, Artificial sequence
  Synthetic oligonucleotide
cgccatgcttagagac

SEQ ID NO: 3544 - DNA, 16 bp, Artificial sequence
  Synthetic oligonucleotide
tgccaaggaccaaacc

SEQ ID NO: 3545 - DNA, 16 bp, Artificial sequence
  Synthetic oligonucleotide
agaacataaccatcgc

SEQ ID NO: 3546 - DNA, 16 bp, Artificial sequence
  Synthetic oligonucleotide
aaggctaccttaggga

SEQ ID NO: 3547 - DNA, 16 bp, Artificial sequence
  Synthetic oligonucleotide
aaggttcaacaaggcg

SEQ ID NO: 3548 - DNA, 16 bp, Artificial sequence
  Synthetic oligonucleotide
agctggagtagactcc

SEQ ID NO: 3549 - DNA, 16 bp, Artificial sequence
  Synthetic oligonucleotide
ccctgtactcaactgc

SEQ ID NO: 3550 - DNA, 16 bp, Artificial sequence
  Synthetic oligonucleotide
ccaaagggtattgtgg

SEQ ID NO: 3551 - DNA, 16 bp, Artificial sequence
  Synthetic oligonucleotide
acctattctgtaggcc

SEQ ID NO: 3552 - DNA, 16 bp, Artificial sequence
  Synthetic oligonucleotide
agtctaggaccatgcc

SEQ ID NO: 3553 - DNA, 16 bp, Artificial sequence
  Synthetic oligonucleotide
aaagacccccccagag

SEQ ID NO: 3554 - DNA, 16 bp, Artificial sequence
  Synthetic oligonucleotide
tgctttccgcactctc

SEQ ID NO: 3555 - DNA, 16 bp, Artificial sequence
  Synthetic oligonucleotide
gtccgggttcctgtag

SEQ ID NO: 3556 - DNA, 16 bp, Artificial sequence
  Synthetic oligonucleotide
cgcggccggctggccg

SEQ ID NO: 3557 - DNA, 16 bp, Artificial sequence
  Synthetic oligonucleotide
gggtactcgccggtcc

SEQ ID NO: 3558 - DNA, 16 bp, Artificial sequence
  Synthetic oligonucleotide
tcccgtgttccagctt

SEQ ID NO: 3559 - DNA, 16 bp, Artificial sequence
  Synthetic oligonucleotide
ctaacccgggcggaga

SEQ ID NO: 3560 - DNA, 16 bp, Artificial sequence
  Synthetic oligonucleotide
gtgcctaccctcgaac

SEQ ID NO: 3561 - DNA, 16 bp, Artificial sequence
  Synthetic oligonucleotide
gtcgcgggcttcttcc

SEQ ID NO: 3562 - DNA, 16 bp, Artificial sequence
  Synthetic oligonucleotide
gcacccggaacgatac

SEQ ID NO: 3563 - DNA, 16 bp, Artificial sequence
  Synthetic oligonucleotide
aagttcgattctccct

SEQ ID NO: 3564 - DNA, 16 bp, Artificial sequence
  Synthetic oligonucleotide
cacactagcccggagc

SEQ ID NO: 3565 - DNA, 16 bp, Artificial sequence
  Synthetic oligonucleotide
aatgggcggagcggaa

SEQ ID NO: 3566 - DNA, 16 bp, Artificial sequence
  Synthetic oligonucleotide
gcttgtaaacccactc

SEQ ID NO: 3567 - DNA, 16 bp, Artificial sequence
  Synthetic oligonucleotide
ccctgcgaacacagag

SEQ ID NO: 3568 - DNA, 16 bp, Artificial sequence
  Synthetic oligonucleotide
cgccaaccgggctaag

SEQ ID NO: 3569 - DNA, 16 bp, Artificial sequence
  Synthetic oligonucleotide
accctgggtcggaaac

SEQ ID NO: 3570 - DNA, 16 bp, Artificial sequence
  Synthetic oligonucleotide
caaggtggaatcgaaa

SEQ ID NO: 3571 - DNA, 16 bp, Artificial sequence
  Synthetic oligonucleotide
aacgactgtgtgctct

SEQ ID NO: 3572 - DNA, 16 bp, Artificial sequence
  Synthetic oligonucleotide
ggcagggctccccggt

SEQ ID NO: 3573 - DNA, 16 bp, Artificial sequence
  Synthetic oligonucleotide
tgtgggtacatttgtg

SEQ ID NO: 3574 - DNA, 16 bp, Artificial sequence
  Synthetic oligonucleotide
catcgctggtcctgat

SEQ ID NO: 3575 - DNA, 16 bp, Artificial sequence
  Synthetic oligonucleotide
catgttcacacaggtc

SEQ ID NO: 3576 - DNA, 16 bp, Artificial sequence
  Synthetic oligonucleotide
tggaaaaaccggagaa

SEQ ID NO: 3577 - DNA, 16 bp, Artificial sequence
  Synthetic oligonucleotide
gggcatcaggaccctt

SEQ ID NO: 3578 - DNA, 16 bp, Artificial sequence
  Synthetic oligonucleotide
cccatggaggcacggg

SEQ ID NO: 3579 - DNA, 16 bp, Artificial sequence
  Synthetic oligonucleotide
caggcggtggccctcc

SEQ ID NO: 3580 - DNA, 16 bp, Artificial sequence
  Synthetic oligonucleotide
aaggctccggtgtagc

SEQ ID NO: 3581 - DNA, 16 bp, Artificial sequence
  Synthetic oligonucleotide
gcccgcggccatcata

SEQ ID NO: 3582 - DNA, 16 bp, Artificial sequence
  Synthetic oligonucleotide
ggctgacagggcgcac

SEQ ID NO: 3583 - DNA, 16 bp, Artificial sequence
  Synthetic oligonucleotide
ccgcgcttgctcggca

SEQ ID NO: 3584 - DNA, 16 bp, Artificial sequence
  Synthetic oligonucleotide
tccgggttccggcaga

SEQ ID NO: 3585 - DNA, 16 bp, Artificial sequence
  Synthetic oligonucleotide
cggtcgcggttcagca

SEQ ID NO: 3586 - DNA, 16 bp, Artificial sequence
  Synthetic oligonucleotide
gtgggacatgaagcct

SEQ ID NO: 3587 - DNA, 16 bp, Artificial sequence
  Synthetic oligonucleotide
aggcttcggcggtgcc

SEQ ID NO: 3588 - DNA, 16 bp, Artificial sequence
  Synthetic oligonucleotide
aaggcggctgctcccg

SEQ ID NO: 3589 - DNA, 16 bp, Artificial sequence
  Synthetic oligonucleotide
ggagccgctgcccgca

SEQ ID NO: 3590 - DNA, 16 bp, Artificial sequence
  Synthetic oligonucleotide
tcatcgaagacagact

SEQ ID NO: 3591 - DNA, 16 bp, Artificial sequence
  Synthetic oligonucleotide
agcgcggcgatgtagg

SEQ ID NO: 3592 - DNA, 16 bp, Artificial sequence
  Synthetic oligonucleotide
gccggcgcagaaactg

SEQ ID NO: 3593 - DNA, 16 bp, Artificial sequence
  Synthetic oligonucleotide
accaccgtcagatcct

SEQ ID NO: 3594 - DNA, 16 bp, Artificial sequence
  Synthetic oligonucleotide
agcggtaggagcgcac

SEQ ID NO: 3595 - DNA, 16 bp, Artificial sequence
  Synthetic oligonucleotide
ggcgcaacagagccag

SEQ ID NO: 3596 - DNA, 16 bp, Artificial sequence
  Synthetic oligonucleotide
agctgccgtccgcatc

SEQ ID NO: 3597 - DNA, 16 bp, Artificial sequence
  Synthetic oligonucleotide
gcacaccggctgaacg

SEQ ID NO: 3598 - DNA, 16 bp, Artificial sequence
  Synthetic oligonucleotide
gccacctggcagagcg

SEQ ID NO: 3599 - DNA, 16 bp, Artificial sequence
  Synthetic oligonucleotide
ctccgccccctcgaac

SEQ ID NO: 3600 - DNA, 16 bp, Artificial sequence
  Synthetic oligonucleotide
aggaacggtacctgcg

SEQ ID NO: 3601 - DNA, 16 bp, Artificial sequence
  Synthetic oligonucleotide
ggaaccctgcgcagag

SEQ ID NO: 3602 - DNA, 16 bp, Artificial sequence
  Synthetic oligonucleotide
gcacgcatcggtgccg

SEQ ID NO: 3603 - DNA, 16 bp, Artificial sequence
  Synthetic oligonucleotide
atgatgccttgcaggg

SEQ ID NO: 3604 - DNA, 16 bp, Artificial sequence
  Synthetic oligonucleotide
ctggcttgttgcggtc

SEQ ID NO: 3605 - DNA, 16 bp, Artificial sequence
  Synthetic oligonucleotide
gccaggtagtaggcca

SEQ ID NO: 3606 - DNA, 16 bp, Artificial sequence
  Synthetic oligonucleotide
tccctgagcaatcagg

SEQ ID NO: 3607 - DNA, 16 bp, Artificial sequence
  Synthetic oligonucleotide
actgcggaatcaccaa

SEQ ID NO: 3608 - DNA, 16 bp, Artificial sequence
  Synthetic oligonucleotide
gaatgggacacaatct

SEQ ID NO: 3609 - DNA, 16 bp, Artificial sequence
  Synthetic oligonucleotide
ttcctgcgccatcctg

SEQ ID NO: 3610 - DNA, 16 bp, Artificial sequence
  Synthetic oligonucleotide
ccgaaagtgttgactc

SEQ ID NO: 3611 - DNA, 16 bp, Artificial sequence
  Synthetic oligonucleotide
gtgatagcgacccccc

SEQ ID NO: 3612 - DNA, 16 bp, Artificial sequence
  Synthetic oligonucleotide
ccccgttgtcttctta

SEQ ID NO: 3613 - DNA, 16 bp, Artificial sequence
  Synthetic oligonucleotide
ataagtcatagcctgc

SEQ ID NO: 3614 - DNA, 16 bp, Artificial sequence
  Synthetic oligonucleotide
ctagactgccctgaga

SEQ ID NO: 3615 - DNA, 16 bp, Artificial sequence
  Synthetic oligonucleotide
cccatgggcataagac

SEQ ID NO: 3616 - DNA, 16 bp, Artificial sequence
  Synthetic oligonucleotide
agcacatatctcaagc

SEQ ID NO: 3617 - DNA, 16 bp, Artificial sequence
  Synthetic oligonucleotide
cctaagaggtttactg

SEQ ID NO: 3618 - DNA, 16 bp, Artificial sequence
  Synthetic oligonucleotide
tgtaggtaatttagtg

SEQ ID NO: 3619 - DNA, 16 bp, Artificial sequence
  Synthetic oligonucleotide
caagtttgggtaaggc

SEQ ID NO: 3620 - DNA, 16 bp, Artificial sequence
  Synthetic oligonucleotide
gcacttgccaaggacc

SEQ ID NO: 3621 - DNA, 16 bp, Artificial sequence
  Synthetic oligonucleotide
tagaacataaccatcg

SEQ ID NO: 3622 - DNA, 16 bp, Artificial sequence
  Synthetic oligonucleotide
gaaggctaccttaggg

SEQ ID NO: 3623 - DNA, 16 bp, Artificial sequence
  Synthetic oligonucleotide
gttaaggttcaacaag

SEQ ID NO: 3624 - DNA, 16 bp, Artificial sequence
  Synthetic oligonucleotide
tagctggagtagactc

SEQ ID NO: 3625 - DNA, 16 bp, Artificial sequence
  Synthetic oligonucleotide
ggacttcccctgtact

SEQ ID NO: 3626 - DNA, 16 bp, Artificial sequence
  Synthetic oligonucleotide
tccaaagggtattgtg

SEQ ID NO: 3627 - DNA, 16 bp, Artificial sequence
  Synthetic oligonucleotide
aacctattctgtaggc

SEQ ID NO: 3628 - DNA, 16 bp, Artificial sequence
  Synthetic oligonucleotide
gagtctaggaccatgc

SEQ ID NO: 3629 - DNA, 16 bp, Artificial sequence
  Synthetic oligonucleotide
ctaaagacccccccag

SEQ ID NO: 3630 - DNA, 16 bp, Artificial sequence
  Synthetic oligonucleotide
atctgctttccgcact

SEQ ID NO: 3631 - DNA, 16 bp, Artificial sequence
  Synthetic oligonucleotide
tgtccgggttcctgta

SEQ ID NO: 3632 - DNA, 16 bp, Artificial sequence
  Synthetic oligonucleotide
cccgcggccggctggc

SEQ ID NO: 3633 - DNA, 16 bp, Artificial sequence
  Synthetic oligonucleotide
gcgggtactcgccggt

SEQ ID NO: 3634 - DNA, 16 bp, Artificial sequence
  Synthetic oligonucleotide
aatcccgtgttccagc

SEQ ID NO: 3635 - DNA, 16 bp, Artificial sequence
  Synthetic oligonucleotide
gctaacccgggcggag

SEQ ID NO: 3636 - DNA, 16 bp, Artificial sequence
  Synthetic oligonucleotide
gcagttgtgcctaccc

SEQ ID NO: 3637 - DNA, 16 bp, Artificial sequence
  Synthetic oligonucleotide
agtcgcgggcttcttc

SEQ ID NO: 3638 - DNA, 16 bp, Artificial sequence
  Synthetic oligonucleotide
aggcacccggaacgat

SEQ ID NO: 3639 - DNA, 16 bp, Artificial sequence
  Synthetic oligonucleotide
caagttcgattctccc

SEQ ID NO: 3640 - DNA, 16 bp, Artificial sequence
  Synthetic oligonucleotide
ccacactagcccggag

SEQ ID NO: 3641 - DNA, 16 bp, Artificial sequence
  Synthetic oligonucleotide
gaatgggcggagcgga

SEQ ID NO: 3642 - DNA, 16 bp, Artificial sequence
  Synthetic oligonucleotide
cgcttgtaaacccact

SEQ ID NO: 3643 - DNA, 16 bp, Artificial sequence
  Synthetic oligonucleotide
cccctgcgaacacaga

SEQ ID NO: 3644 - DNA, 16 bp, Artificial sequence
  Synthetic oligonucleotide
gcgccaaccgggctaa

SEQ ID NO: 3645 - DNA, 16 bp, Artificial sequence
  Synthetic oligonucleotide
caccctgggtcggaaa

SEQ ID NO: 3646 - DNA, 16 bp, Artificial sequence
  Synthetic oligonucleotide
ccaaggtggaatcgaa

SEQ ID NO: 3647 - DNA, 16 bp, Artificial sequence
  Synthetic oligonucleotide
gaacgactgtgtgctc

SEQ ID NO: 3648 - DNA, 16 bp, Artificial sequence
  Synthetic oligonucleotide
tggcagggctccccgg

SEQ ID NO: 3649 - DNA, 16 bp, Artificial sequence
  Synthetic oligonucleotide
ttgtgggtacatttgt

SEQ ID NO: 3650 - DNA, 16 bp, Artificial sequence
  Synthetic oligonucleotide
cccatcgctggtcctg

SEQ ID NO: 3651 - DNA, 16 bp, Artificial sequence
  Synthetic oligonucleotide
cgcttggcatgttcac

SEQ ID NO: 3652 - DNA, 16 bp, Artificial sequence
  Synthetic oligonucleotide
gtggaaaaaccggaga

SEQ ID NO: 3653 - DNA, 16 bp, Artificial sequence
  Synthetic oligonucleotide
tgggcatcaggaccct

SEQ ID NO: 3654 - DNA, 16 bp, Artificial sequence
  Synthetic oligonucleotide
ccccatggaggcacgg

SEQ ID NO: 3655 - DNA, 16 bp, Artificial sequence
  Synthetic oligonucleotide
acaggcggtggccctc

SEQ ID NO: 3656 - DNA, 16 bp, Artificial sequence
  Synthetic oligonucleotide
cagaaggctccggtgt

SEQ ID NO: 3657 - DNA, 16 bp, Artificial sequence
  Synthetic oligonucleotide
gagcccgcggccatca

SEQ ID NO: 3658 - DNA, 16 bp, Artificial sequence
  Synthetic oligonucleotide
cggctgacagggcgca

SEQ ID NO: 3659 - DNA, 16 bp, Artificial sequence
  Synthetic oligonucleotide
tccgcgcttgctcggc

SEQ ID NO: 3660 - DNA, 16 bp, Artificial sequence
  Synthetic oligonucleotide
gtccgggttccggcag

SEQ ID NO: 3661 - DNA, 16 bp, Artificial sequence
  Synthetic oligonucleotide
ccggtcgcggttcagc

SEQ ID NO: 3662 - DNA, 16 bp, Artificial sequence
  Synthetic oligonucleotide
agtgggacatgaagcc

SEQ ID NO: 3663 - DNA, 16 bp, Artificial sequence
  Synthetic oligonucleotide
gaggcttcggcggtgc

SEQ ID NO: 3664 - DNA, 16 bp, Artificial sequence
  Synthetic oligonucleotide
gaaggcggctgctccc

SEQ ID NO: 3665 - DNA, 16 bp, Artificial sequence
  Synthetic oligonucleotide
cggagccgctgcccgc

SEQ ID NO: 3666 - DNA, 16 bp, Artificial sequence
  Synthetic oligonucleotide
gtcatcgaagacagac

SEQ ID NO: 3667 - DNA, 16 bp, Artificial sequence
  Synthetic oligonucleotide
cagcgcggcgatgtag

SEQ ID NO: 3668 - DNA, 16 bp, Artificial sequence
  Synthetic oligonucleotide
ctgccggcgcagaaac

SEQ ID NO: 3669 - DNA, 16 bp, Artificial sequence
  Synthetic oligonucleotide
caccaccgtcagatcc

SEQ ID NO: 3670 - DNA, 16 bp, Artificial sequence
  Synthetic oligonucleotide
aagcggtaggagcgca

SEQ ID NO: 3671 - DNA, 16 bp, Artificial sequence
  Synthetic oligonucleotide
aggcgcaacagagcca

SEQ ID NO: 3672 - DNA, 16 bp, Artificial sequence
  Synthetic oligonucleotide
cagctgccgtccgcat

SEQ ID NO: 3673 - DNA, 16 bp, Artificial sequence
  Synthetic oligonucleotide
ggcacaccggctgaac

SEQ ID NO: 3674 - DNA, 16 bp, Artificial sequence
  Synthetic oligonucleotide
ccggccacctggcaga

SEQ ID NO: 3675 - DNA, 16 bp, Artificial sequence
  Synthetic oligonucleotide
tcctccgccccctcga

SEQ ID NO: 3676 - DNA, 16 bp, Artificial sequence
  Synthetic oligonucleotide
gaggaacggtacctgc

SEQ ID NO: 3677 - DNA, 16 bp, Artificial sequence
  Synthetic oligonucleotide
aggaaccctgcgcaga

SEQ ID NO: 3678 - DNA, 16 bp, Artificial sequence
  Synthetic oligonucleotide
tggcacgcatcggtgc

SEQ ID NO: 3679 - DNA, 16 bp, Artificial sequence
  Synthetic oligonucleotide
ctgatgatgccttgca

SEQ ID NO: 3680 - DNA, 16 bp, Artificial sequence
  Synthetic oligonucleotide
cctggcttgttgcggt

SEQ ID NO: 3681 - DNA, 16 bp, Artificial sequence
  Synthetic oligonucleotide
ggccaggtagtaggcc

SEQ ID NO: 3682 - DNA, 16 bp, Artificial sequence
  Synthetic oligonucleotide
gtccctgagcaatcag

SEQ ID NO: 3683 - DNA, 16 bp, Artificial sequence
  Synthetic oligonucleotide
cactgcggaatcacca

SEQ ID NO: 3684 - DNA, 16 bp, Artificial sequence
  Synthetic oligonucleotide
ggaatgggacacaatc

SEQ ID NO: 3685 - DNA, 16 bp, Artificial sequence
  Synthetic oligonucleotide
gttcctgcgccatcct

SEQ ID NO: 3686 - DNA, 16 bp, Artificial sequence
  Synthetic oligonucleotide
accgaaagtgttgact

SEQ ID NO: 3687 - DNA, 16 bp, Artificial sequence
  Synthetic oligonucleotide
tgtgatagcgaccccc

SEQ ID NO: 3688 - DNA, 16 bp, Artificial sequence
  Synthetic oligonucleotide
cccccgttgtcttctt

SEQ ID NO: 3689 - DNA, 16 bp, Artificial sequence
  Synthetic oligonucleotide
tataagtcatagcctg

SEQ ID NO: 3690 - DNA, 16 bp, Artificial sequence
  Synthetic oligonucleotide
gactagactgccctga

SEQ ID NO: 3691 - DNA, 16 bp, Artificial sequence
  Synthetic oligonucleotide
gcccatgggcataaga

SEQ ID NO: 3692 - DNA, 16 bp, Artificial sequence
  Synthetic oligonucleotide
cgccagcagcacatat

SEQ ID NO: 3693 - DNA, 16 bp, Artificial sequence
  Synthetic oligonucleotide
ccctaagaggtttact

SEQ ID NO: 3694 - DNA, 16 bp, Artificial sequence
  Synthetic oligonucleotide
ctggcatgtaggtaat

SEQ ID NO: 3695 - DNA, 16 bp, Artificial sequence
  Synthetic oligonucleotide
ccaagtttgggtaagg

SEQ ID NO: 3696 - DNA, 16 bp, Artificial sequence
  Synthetic oligonucleotide
gtgcacttgccaagga

SEQ ID NO: 3697 - DNA, 16 bp, Artificial sequence
  Synthetic oligonucleotide
tgctagttcaatgttc

SEQ ID NO: 3698 - DNA, 16 bp, Artificial sequence
  Synthetic oligonucleotide
aagaaggctaccttag

SEQ ID NO: 3699 - DNA, 16 bp, Artificial sequence
  Synthetic oligonucleotide
ccagttaaggttcaac

SEQ ID NO: 3700 - DNA, 16 bp, Artificial sequence
  Synthetic oligonucleotide
atagctggagtagact

SEQ ID NO: 3701 - DNA, 16 bp, Artificial sequence
  Synthetic oligonucleotide
gggacaacacactctc

SEQ ID NO: 3702 - DNA, 16 bp, Artificial sequence
  Synthetic oligonucleotide
ggacttccaaagggta

SEQ ID NO: 3703 - DNA, 16 bp, Artificial sequence
  Synthetic oligonucleotide
caacctattctgtagg

SEQ ID NO: 3704 - DNA, 16 bp, Artificial sequence
  Synthetic oligonucleotide
gagagtctaggaccat

SEQ ID NO: 3705 - DNA, 16 bp, Artificial sequence
  Synthetic oligonucleotide
gcctaaagaccccccc

SEQ ID NO: 3706 - DNA, 16 bp, Artificial sequence
  Synthetic oligonucleotide
tctcatctgctttccg

SEQ ID NO: 3707 - DNA, 16 bp, Artificial sequence
  Synthetic oligonucleotide
ttgtccgggttcctgt

SEQ ID NO: 3708 - DNA, 16 bp, Artificial sequence
  Synthetic oligonucleotide
gagcccgcggccggct

SEQ ID NO: 3709 - DNA, 16 bp, Artificial sequence
  Synthetic oligonucleotide
ggcgggtactcgccgg

SEQ ID NO: 3710 - DNA, 16 bp, Artificial sequence
  Synthetic oligonucleotide
caatcccgtgttccag

SEQ ID NO: 3711 - DNA, 16 bp, Artificial sequence
  Synthetic oligonucleotide
agctaacccgggcgga

SEQ ID NO: 3712 - DNA, 16 bp, Artificial sequence
  Synthetic oligonucleotide
tagcagttgtgcctac

SEQ ID NO: 3713 - DNA, 16 bp, Artificial sequence
  Synthetic oligonucleotide
aagtcgcgggcttctt

SEQ ID NO: 3714 - DNA, 16 bp, Artificial sequence
  Synthetic oligonucleotide
gtaggcacccggaacg

SEQ ID NO: 3715 - DNA, 16 bp, Artificial sequence
  Synthetic oligonucleotide
gcaagttcgattctcc

SEQ ID NO: 3716 - DNA, 16 bp, Artificial sequence
  Synthetic oligonucleotide
tcccacactagcccgg

SEQ ID NO: 3717 - DNA, 16 bp, Artificial sequence
  Synthetic oligonucleotide
tgaatgggcggagcgg

SEQ ID NO: 3718 - DNA, 16 bp, Artificial sequence
  Synthetic oligonucleotide
gcgcttgtaaacccac

SEQ ID NO: 3719 - DNA, 16 bp, Artificial sequence
  Synthetic oligonucleotide
gcccctgcgaacacag

SEQ ID NO: 3720 - DNA, 16 bp, Artificial sequence
  Synthetic oligonucleotide
gcctgacggcctcggg

SEQ ID NO: 3721 - DNA, 16 bp, Artificial sequence
  Synthetic oligonucleotide
tcaccctgggtcggaa

SEQ ID NO: 3722 - DNA, 16 bp, Artificial sequence
  Synthetic oligonucleotide
cccaaggtggaatcga

SEQ ID NO: 3723 - DNA, 16 bp, Artificial sequence
  Synthetic oligonucleotide
agaacgactgtgtgct

SEQ ID NO: 3724 - DNA, 16 bp, Artificial sequence
  Synthetic oligonucleotide
gtggcagggctccccg

SEQ ID NO: 3725 - DNA, 16 bp, Artificial sequence
  Synthetic oligonucleotide
cttgtgggtacatttg

SEQ ID NO: 3726 - DNA, 16 bp, Artificial sequence
  Synthetic oligonucleotide
ccccatcgctggtcct

SEQ ID NO: 3727 - DNA, 16 bp, Artificial sequence
  Synthetic oligonucleotide
ccgcttggcatgttca

SEQ ID NO: 3728 - DNA, 16 bp, Artificial sequence
  Synthetic oligonucleotide
tgtggaaaaaccggag

SEQ ID NO: 3729 - DNA, 16 bp, Artificial sequence
  Synthetic oligonucleotide
gtgggcatcaggaccc

SEQ ID NO: 3730 - DNA, 16 bp, Artificial sequence
  Synthetic oligonucleotide
cccccatggaggcacg

SEQ ID NO: 3731 - DNA, 16 bp, Artificial sequence
  Synthetic oligonucleotide
cacaggcggtggccct

SEQ ID NO: 3732 - DNA, 16 bp, Artificial sequence
  Synthetic oligonucleotide
gcagaaggctccggtg

SEQ ID NO: 3733 - DNA, 16 bp, Artificial sequence
  Synthetic oligonucleotide
gctgagcccgcggcca

SEQ ID NO: 3734 - DNA, 16 bp, Artificial sequence
  Synthetic oligonucleotide
acggctgacagggcgc

SEQ ID NO: 3735 - DNA, 16 bp, Artificial sequence
  Synthetic oligonucleotide
ttccgcgcttgctcgg

SEQ ID NO: 3736 - DNA, 16 bp, Artificial sequence
  Synthetic oligonucleotide
tgtccgggttccggca

SEQ ID NO: 3737 - DNA, 16 bp, Artificial sequence
  Synthetic oligonucleotide
gccggtcgcggttcag

SEQ ID NO: 3738 - DNA, 16 bp, Artificial sequence
  Synthetic oligonucleotide
gagtgggacatgaagc

SEQ ID NO: 3739 - DNA, 16 bp, Artificial sequence
  Synthetic oligonucleotide
gctgaggcttcggcgg

SEQ ID NO: 3740 - DNA, 16 bp, Artificial sequence
  Synthetic oligonucleotide
gggaaggcggctgctc

SEQ ID NO: 3741 - DNA, 16 bp, Artificial sequence
  Synthetic oligonucleotide
gcggagccgctgcccg

SEQ ID NO: 3742 - DNA, 16 bp, Artificial sequence
  Synthetic oligonucleotide
ggtcatcgaagacaga

SEQ ID NO: 3743 - DNA, 16 bp, Artificial sequence
  Synthetic oligonucleotide
tacagcgcggcgatgt

SEQ ID NO: 3744 - DNA, 16 bp, Artificial sequence
  Synthetic oligonucleotide
aggctgccggcgcaga

SEQ ID NO: 3745 - DNA, 16 bp, Artificial sequence
  Synthetic oligonucleotide
agcaccaccgtcagat

SEQ ID NO: 3746 - DNA, 16 bp, Artificial sequence
  Synthetic oligonucleotide
caagcggtaggagcgc

SEQ ID NO: 3747 - DNA, 16 bp, Artificial sequence
  Synthetic oligonucleotide
aaggcgcaacagagcc

SEQ ID NO: 3748 - DNA, 16 bp, Artificial sequence
  Synthetic oligonucleotide
gcagctgccgtccgca

SEQ ID NO: 3749 - DNA, 16 bp, Artificial sequence
  Synthetic oligonucleotide
aggcacaccggctgaa

SEQ ID NO: 3750 - DNA, 16 bp, Artificial sequence
  Synthetic oligonucleotide
gccggccacctggcag

SEQ ID NO: 3751 - DNA, 16 bp, Artificial sequence
  Synthetic oligonucleotide
attcctccgccccctc

SEQ ID NO: 3752 - DNA, 16 bp, Artificial sequence
  Synthetic oligonucleotide
agaggaacggtacctg

SEQ ID NO: 3753 - DNA, 16 bp, Artificial sequence
  Synthetic oligonucleotide
gaggaaccctgcgcag

SEQ ID NO: 3754 - DNA, 16 bp, Artificial sequence
  Synthetic oligonucleotide
ctggcacgcatcggtg

SEQ ID NO: 3755 - DNA, 16 bp, Artificial sequence
  Synthetic oligonucleotide
gctgatgatgccttgc

SEQ ID NO: 3756 - DNA, 16 bp, Artificial sequence
  Synthetic oligonucleotide
gcctggcttgttgcgg

SEQ ID NO: 3757 - DNA, 16 bp, Artificial sequence
  Synthetic oligonucleotide
aggccaggtagtaggc

SEQ ID NO: 3758 - DNA, 16 bp, Artificial sequence
  Synthetic oligonucleotide
agtccctgagcaatca

SEQ ID NO: 3759 - DNA, 16 bp, Artificial sequence
  Synthetic oligonucleotide
tcactgcggaatcacc

SEQ ID NO: 3760 - DNA, 16 bp, Artificial sequence
  Synthetic oligonucleotide
agctggccgcactggg

SEQ ID NO: 3761 - DNA, 16 bp, Artificial sequence
  Synthetic oligonucleotide
agttcctgcgccatcc

SEQ ID NO: 3762 - DNA, 16 bp, Artificial sequence
  Synthetic oligonucleotide
caccgaaagtgttgac

SEQ ID NO: 3763 - DNA, 16 bp, Artificial sequence
  Synthetic oligonucleotide
ctgtgatagcgacccc

SEQ ID NO: 3764 - DNA, 16 bp, Artificial sequence
  Synthetic oligonucleotide
ccccccgttgtcttct

SEQ ID NO: 3765 - DNA, 16 bp, Artificial sequence
  Synthetic oligonucleotide
ctataagtcatagcct

SEQ ID NO: 3766 - DNA, 16 bp, Artificial sequence
  Synthetic oligonucleotide
tagactagactgccct

SEQ ID NO: 3767 - DNA, 16 bp, Artificial sequence
  Synthetic oligonucleotide
ctctagtgcccatggg

SEQ ID NO: 3768 - DNA, 16 bp, Artificial sequence
  Synthetic oligonucleotide
cccattgaaggccctg

SEQ ID NO: 3769 - DNA, 16 bp, Artificial sequence
  Synthetic oligonucleotide
accctaagaggtttac

SEQ ID NO: 3770 - DNA, 16 bp, Artificial sequence
  Synthetic oligonucleotide
tgccacactctaggta

SEQ ID NO: 3771 - DNA, 16 bp, Artificial sequence
  Synthetic oligonucleotide
gcaccaagtttgggta

SEQ ID NO: 3772 - DNA, 16 bp, Artificial sequence
  Synthetic oligonucleotide
aagtgcacttgccaag

SEQ ID NO: 3773 - DNA, 16 bp, Artificial sequence
  Synthetic oligonucleotide
gctgttggttgatgaa

SEQ ID NO: 3774 - DNA, 16 bp, Artificial sequence
  Synthetic oligonucleotide
caagaaggctacctta

SEQ ID NO: 3775 - DNA, 16 bp, Artificial sequence
  Synthetic oligonucleotide
cattcccagttaaggt

SEQ ID NO: 3776 - DNA, 16 bp, Artificial sequence
  Synthetic oligonucleotide
gatagctggagtagac

SEQ ID NO: 3777 - DNA, 16 bp, Artificial sequence
  Synthetic oligonucleotide
tagtcttaccagggct

SEQ ID NO: 3778 - DNA, 16 bp, Artificial sequence
  Synthetic oligonucleotide
atgggaccactccttc

SEQ ID NO: 3779 - DNA, 16 bp, Artificial sequence
  Synthetic oligonucleotide
gcaacctattctgtag

SEQ ID NO: 3780 - DNA, 16 bp, Artificial sequence
  Synthetic oligonucleotide
ggagagtctaggacca

SEQ ID NO: 3781 - DNA, 16 bp, Artificial sequence
  Synthetic oligonucleotide
ggcctaaagacccccc

SEQ ID NO: 3782 - DNA, 16 bp, Artificial sequence
  Synthetic oligonucleotide
gcaccggcagaaggcg

SEQ ID NO: 3783 - DNA, 16 bp, Artificial sequence
  Synthetic oligonucleotide
ttcctaacctcccggg

SEQ ID NO: 3784 - DNA, 16 bp, Artificial sequence
  Synthetic oligonucleotide
ggagagcccgcggccg

SEQ ID NO: 3785 - DNA, 16 bp, Artificial sequence
  Synthetic oligonucleotide
acggaggagccgcggc

SEQ ID NO: 3786 - DNA, 16 bp, Artificial sequence
  Synthetic oligonucleotide
ccaatcccgtgttcca

SEQ ID NO: 3787 - DNA, 16 bp, Artificial sequence
  Synthetic oligonucleotide
gagctaacccgggcgg

SEQ ID NO: 3788 - DNA, 16 bp, Artificial sequence
  Synthetic oligonucleotide
ccctagcagttgtgcc

SEQ ID NO: 3789 - DNA, 16 bp, Artificial sequence
  Synthetic oligonucleotide
aaagtcgcgggcttct

SEQ ID NO: 3790 - DNA, 16 bp, Artificial sequence
  Synthetic oligonucleotide
ctgtaggcacccggaa

SEQ ID NO: 3791 - DNA, 16 bp, Artificial sequence
  Synthetic oligonucleotide
agcaagttcgattctc

SEQ ID NO: 3792 - DNA, 16 bp, Artificial sequence
  Synthetic oligonucleotide
cgcagaacctggctcc

SEQ ID NO: 3793 - DNA, 16 bp, Artificial sequence
  Synthetic oligonucleotide
ttgaatgggcggagcg

SEQ ID NO: 3794 - DNA, 16 bp, Artificial sequence
  Synthetic oligonucleotide
acgatggacaaagctg

SEQ ID NO: 3795 - DNA, 16 bp, Artificial sequence
  Synthetic oligonucleotide
tccgcccctgcgaaca

SEQ ID NO: 3796 - DNA, 16 bp, Artificial sequence
  Synthetic oligonucleotide
gatttgtgcctgacgg

SEQ ID NO: 3797 - DNA, 16 bp, Artificial sequence
  Synthetic oligonucleotide
aatcaccctgggtcgg

SEQ ID NO: 3798 - DNA, 16 bp, Artificial sequence
  Synthetic oligonucleotide
tcccaaggtggaatcg

SEQ ID NO: 3799 - DNA, 16 bp, Artificial sequence
  Synthetic oligonucleotide
gagaacgactgtgtgc

SEQ ID NO: 3800 - DNA, 16 bp, Artificial sequence
  Synthetic oligonucleotide
cggtggtactggaagg

SEQ ID NO: 3801 - DNA, 16 bp, Artificial sequence
  Synthetic oligonucleotide
cccttgtgggtacatt

SEQ ID NO: 3802 - DNA, 16 bp, Artificial sequence
  Synthetic oligonucleotide
tccccatcgctggtcc

SEQ ID NO: 3803 - DNA, 16 bp, Artificial sequence
  Synthetic oligonucleotide
gccgcttggcatgttc

SEQ ID NO: 3804 - DNA, 16 bp, Artificial sequence
  Synthetic oligonucleotide
cttgtggaaaaaccgg

SEQ ID NO: 3805 - DNA, 16 bp, Artificial sequence
  Synthetic oligonucleotide
agtgggcatcaggacc

SEQ ID NO: 3806 - DNA, 16 bp, Artificial sequence
  Synthetic oligonucleotide
acccccatggaggcac

SEQ ID NO: 3807 - DNA, 16 bp, Artificial sequence
  Synthetic oligonucleotide
gcacaggcggtggccc

SEQ ID NO: 3808 - DNA, 16 bp, Artificial sequence
  Synthetic oligonucleotide
cgcagaaggctccggt

SEQ ID NO: 3809 - DNA, 16 bp, Artificial sequence
  Synthetic oligonucleotide
cggtagctgagcccgc

SEQ ID NO: 3810 - DNA, 16 bp, Artificial sequence
  Synthetic oligonucleotide
cacggctgacagggcg

SEQ ID NO: 3811 - DNA, 16 bp, Artificial sequence
  Synthetic oligonucleotide
gttccgcgcttgctcg

SEQ ID NO: 3812 - DNA, 16 bp, Artificial sequence
  Synthetic oligonucleotide
ttgtccgggttccggc

SEQ ID NO: 3813 - DNA, 16 bp, Artificial sequence
  Synthetic oligonucleotide
agccggtcgcggttca

SEQ ID NO: 3814 - DNA, 16 bp, Artificial sequence
  Synthetic oligonucleotide
tgagtgggacatgaag

SEQ ID NO: 3815 - DNA, 16 bp, Artificial sequence
  Synthetic oligonucleotide
ggctgaggcttcggcg

SEQ ID NO: 3816 - DNA, 16 bp, Artificial sequence
  Synthetic oligonucleotide
agggaaggcggctgct

SEQ ID NO: 3817 - DNA, 16 bp, Artificial sequence
  Synthetic oligonucleotide
tgcggagccgctgccc

SEQ ID NO: 3818 - DNA, 16 bp, Artificial sequence
  Synthetic oligonucleotide
gcgggtcatcgaagac

SEQ ID NO: 3819 - DNA, 16 bp, Artificial sequence
  Synthetic oligonucleotide
gtacagcgcggcgatg

SEQ ID NO: 3820 - DNA, 16 bp, Artificial sequence
  Synthetic oligonucleotide
tgaggctgccggcgca

SEQ ID NO: 3821 - DNA, 16 bp, Artificial sequence
  Synthetic oligonucleotide
gagcaccaccgtcaga

SEQ ID NO: 3822 - DNA, 16 bp, Artificial sequence
  Synthetic oligonucleotide
gcaagcggtaggagcg

SEQ ID NO: 3823 - DNA, 16 bp, Artificial sequence
  Synthetic oligonucleotide
gaaggcgcaacagagc

SEQ ID NO: 3824 - DNA, 16 bp, Artificial sequence
  Synthetic oligonucleotide
cgcagctgccgtccgc

SEQ ID NO: 3825 - DNA, 16 bp, Artificial sequence
  Synthetic oligonucleotide
caggcacaccggctga

SEQ ID NO: 3826 - DNA, 16 bp, Artificial sequence
  Synthetic oligonucleotide
tggccccagccggcca

SEQ ID NO: 3827 - DNA, 16 bp, Artificial sequence
  Synthetic oligonucleotide
tattcctccgccccct

SEQ ID NO: 3828 - DNA, 16 bp, Artificial sequence
  Synthetic oligonucleotide
gagaggaacggtacct

SEQ ID NO: 3829 - DNA, 16 bp, Artificial sequence
  Synthetic oligonucleotide
cgaggaaccctgcgca

SEQ ID NO: 3830 - DNA, 16 bp, Artificial sequence
  Synthetic oligonucleotide
tcctcacacaccagcg

SEQ ID NO: 3831 - DNA, 16 bp, Artificial sequence
  Synthetic oligonucleotide
agctgatgatgccttg

SEQ ID NO: 3832 - DNA, 16 bp, Artificial sequence
  Synthetic oligonucleotide
cgcctggcttgttgcg

SEQ ID NO: 3833 - DNA, 16 bp, Artificial sequence
  Synthetic oligonucleotide
ccggatccaggccagg

SEQ ID NO: 3834 - DNA, 16 bp, Artificial sequence
  Synthetic oligonucleotide
gagtccctgagcaatc

SEQ ID NO: 3835 - DNA, 16 bp, Artificial sequence
  Synthetic oligonucleotide
ctcactgcggaatcac

SEQ ID NO: 3836 - DNA, 16 bp, Artificial sequence
  Synthetic oligonucleotide
gcggagctggccgcac

SEQ ID NO: 3837 - DNA, 16 bp, Artificial sequence
  Synthetic oligonucleotide
gagttcctgcgccatc

SEQ ID NO: 3838 - DNA, 16 bp, Artificial sequence
  Synthetic oligonucleotide
tcaccgaaagtgttga

SEQ ID NO: 3839 - DNA, 16 bp, Artificial sequence
  Synthetic oligonucleotide
gctgtgatagcgaccc

SEQ ID NO: 3840 - DNA, 16 bp, Artificial sequence
  Synthetic oligonucleotide
tccccccgttgtcttc

SEQ ID NO: 3841 - DNA, 16 bp, Artificial sequence
  Synthetic oligonucleotide
actataagtcatagcc

SEQ ID NO: 3842 - DNA, 16 bp, Artificial sequence
  Synthetic oligonucleotide
ctagactagactgccc

SEQ ID NO: 3843 - DNA, 16 bp, Artificial sequence
  Synthetic oligonucleotide
actctagtgcccatgg

SEQ ID NO: 3844 - DNA, 16 bp, Artificial sequence
  Synthetic oligonucleotide
gcccattgaaggccct

SEQ ID NO: 3845 - DNA, 16 bp, Artificial sequence
  Synthetic oligonucleotide
atacctcacatgggtt

SEQ ID NO: 3846 - DNA, 16 bp, Artificial sequence
  Synthetic oligonucleotide
gtaaggtccatctggt

SEQ ID NO: 3847 - DNA, 16 bp, Artificial sequence
  Synthetic oligonucleotide
atagggcaccaagttt

SEQ ID NO: 3848 - DNA, 16 bp, Artificial sequence
  Synthetic oligonucleotide
caaagtgcacttgcca

SEQ ID NO: 3849 - DNA, 16 bp, Artificial sequence
  Synthetic oligonucleotide
gatgaatcagcaacac

SEQ ID NO: 3850 - DNA, 16 bp, Artificial sequence
  Synthetic oligonucleotide
acaagaaggctacctt

SEQ ID NO: 3851 - DNA, 16 bp, Artificial sequence
  Synthetic oligonucleotide
ccatttgtgggcatgc

SEQ ID NO: 3852 - DNA, 16 bp, Artificial sequence
  Synthetic oligonucleotide
agatagctggagtaga

SEQ ID NO: 3853 - DNA, 16 bp, Artificial sequence
  Synthetic oligonucleotide
gtagtcttaccagggc

SEQ ID NO: 3854 - DNA, 16 bp, Artificial sequence
  Synthetic oligonucleotide
aatgggaccactcctt

SEQ ID NO: 3855 - DNA, 16 bp, Artificial sequence
  Synthetic oligonucleotide
agcaacctattctgta

SEQ ID NO: 3856 - DNA, 16 bp, Artificial sequence
  Synthetic oligonucleotide
aggagagtctaggacc

SEQ ID NO: 3857 - DNA, 16 bp, Artificial sequence
  Synthetic oligonucleotide
gggcctaaagaccccc

SEQ ID NO: 3858 - DNA, 16 bp, Artificial sequence
  Synthetic oligonucleotide
cgcaccggcagaaggc

SEQ ID NO: 3859 - DNA, 16 bp, Artificial sequence
  Synthetic oligonucleotide
cttcctaacctcccgg

SEQ ID NO: 3860 - DNA, 16 bp, Artificial sequence
  Synthetic oligonucleotide
acggagagcccgcggc

SEQ ID NO: 3861 - DNA, 16 bp, Artificial sequence
  Synthetic oligonucleotide
gacggaggagccgcgg

SEQ ID NO: 3862 - DNA, 16 bp, Artificial sequence
  Synthetic oligonucleotide
cccaatcccgtgttcc

SEQ ID NO: 3863 - DNA, 16 bp, Artificial sequence
  Synthetic oligonucleotide
agagctaacccgggcg

SEQ ID NO: 3864 - DNA, 16 bp, Artificial sequence
  Synthetic oligonucleotide
cccctagcagttgtgc

SEQ ID NO: 3865 - DNA, 16 bp, Artificial sequence
  Synthetic oligonucleotide
caaagtcgcgggcttc

SEQ ID NO: 3866 - DNA, 16 bp, Artificial sequence
  Synthetic oligonucleotide
tctgtaggcacccgga

SEQ ID NO: 3867 - DNA, 16 bp, Artificial sequence
  Synthetic oligonucleotide
gagcaagttcgattct

SEQ ID NO: 3868 - DNA, 16 bp, Artificial sequence
  Synthetic oligonucleotide
tcgcagaacctggctc

SEQ ID NO: 3869 - DNA, 16 bp, Artificial sequence
  Synthetic oligonucleotide
tttgaatgggcggagc

SEQ ID NO: 3870 - DNA, 16 bp, Artificial sequence
  Synthetic oligonucleotide
gacgatggacaaagct

SEQ ID NO: 3871 - DNA, 16 bp, Artificial sequence
  Synthetic oligonucleotide
ctccgcccctgcgaac

SEQ ID NO: 3872 - DNA, 16 bp, Artificial sequence
  Synthetic oligonucleotide
agatttgtgcctgacg

SEQ ID NO: 3873 - DNA, 16 bp, Artificial sequence
  Synthetic oligonucleotide
ggaatcaccctgggtc

SEQ ID NO: 3874 - DNA, 16 bp, Artificial sequence
  Synthetic oligonucleotide
cttcccaaggtggaat

SEQ ID NO: 3875 - DNA, 16 bp, Artificial sequence
  Synthetic oligonucleotide
tgagaacgactgtgtg

SEQ ID NO: 3876 - DNA, 16 bp, Artificial sequence
  Synthetic oligonucleotide
ccggtggtactggaag

SEQ ID NO: 3877 - DNA, 16 bp, Artificial sequence
  Synthetic oligonucleotide
gcccttgtgggtacat

SEQ ID NO: 3878 - DNA, 16 bp, Artificial sequence
  Synthetic oligonucleotide
atccccatcgctggtc

SEQ ID NO: 3879 - DNA, 16 bp, Artificial sequence
  Synthetic oligonucleotide
ggccgcttggcatgtt

SEQ ID NO: 3880 - DNA, 16 bp, Artificial sequence
  Synthetic oligonucleotide
atctcattcttgtgga

SEQ ID NO: 3881 - DNA, 16 bp, Artificial sequence
  Synthetic oligonucleotide
cagtgggcatcaggac

SEQ ID NO: 3882 - DNA, 16 bp, Artificial sequence
  Synthetic oligonucleotide
cgacccccatggaggc

SEQ ID NO: 3883 - DNA, 16 bp, Artificial sequence
  Synthetic oligonucleotide
tggcacaggcggtggc

SEQ ID NO: 3884 - DNA, 16 bp, Artificial sequence
  Synthetic oligonucleotide
tcgcagaaggctccgg

SEQ ID NO: 3885 - DNA, 16 bp, Artificial sequence
  Synthetic oligonucleotide
gcggtagctgagcccg

SEQ ID NO: 3886 - DNA, 16 bp, Artificial sequence
  Synthetic oligonucleotide
cccacggctgacaggg

SEQ ID NO: 3887 - DNA, 16 bp, Artificial sequence
  Synthetic oligonucleotide
agttccgcgcttgctc

SEQ ID NO: 3888 - DNA, 16 bp, Artificial sequence
  Synthetic oligonucleotide
ccacgggcggatgtcg

SEQ ID NO: 3889 - DNA, 16 bp, Artificial sequence
  Synthetic oligonucleotide
cagccggtcgcggttc

SEQ ID NO: 3890 - DNA, 16 bp, Artificial sequence
  Synthetic oligonucleotide
atgagtgggacatgaa

SEQ ID NO: 3891 - DNA, 16 bp, Artificial sequence
  Synthetic oligonucleotide
tgggctgaggcttcgg

SEQ ID NO: 3892 - DNA, 16 bp, Artificial sequence
  Synthetic oligonucleotide
tcagggaaggcggctg

SEQ ID NO: 3893 - DNA, 16 bp, Artificial sequence
  Synthetic oligonucleotide
ttgcggagccgctgcc

SEQ ID NO: 3894 - DNA, 16 bp, Artificial sequence
  Synthetic oligonucleotide
cgcgggtcatcgaaga

SEQ ID NO: 3895 - DNA, 16 bp, Artificial sequence
  Synthetic oligonucleotide
agtacagcgcggcgat

SEQ ID NO: 3896 - DNA, 16 bp, Artificial sequence
  Synthetic oligonucleotide
atgaggctgccggcgc

SEQ ID NO: 3897 - DNA, 16 bp, Artificial sequence
  Synthetic oligonucleotide
gccgagcaccaccgtc

SEQ ID NO: 3898 - DNA, 16 bp, Artificial sequence
  Synthetic oligonucleotide
tgcaagcggtaggagc

SEQ ID NO: 3899 - DNA, 16 bp, Artificial sequence
  Synthetic oligonucleotide
tgaaggcgcaacagag

SEQ ID NO: 3900 - DNA, 16 bp, Artificial sequence
  Synthetic oligonucleotide
cgcgcagctgccgtcc

SEQ ID NO: 3901 - DNA, 16 bp, Artificial sequence
  Synthetic oligonucleotide
gcaggcacaccggctg

SEQ ID NO: 3902 - DNA, 16 bp, Artificial sequence
  Synthetic oligonucleotide
ggtggccccagccggc

SEQ ID NO: 3903 - DNA, 16 bp, Artificial sequence
  Synthetic oligonucleotide
atattcctccgccccc

SEQ ID NO: 3904 - DNA, 16 bp, Artificial sequence
  Synthetic oligonucleotide
ggagaggaacggtacc

SEQ ID NO: 3905 - DNA, 16 bp, Artificial sequence
  Synthetic oligonucleotide
tcgaggaaccctgcgc

SEQ ID NO: 3906 - DNA, 16 bp, Artificial sequence
  Synthetic oligonucleotide
gtcctcacacaccagc

SEQ ID NO: 3907 - DNA, 16 bp, Artificial sequence
  Synthetic oligonucleotide
gatccccagctgatga

SEQ ID NO: 3908 - DNA, 16 bp, Artificial sequence
  Synthetic oligonucleotide
acgcctggcttgttgc

SEQ ID NO: 3909 - DNA, 16 bp, Artificial sequence
  Synthetic oligonucleotide
cccggatccaggccag

SEQ ID NO: 3910 - DNA, 16 bp, Artificial sequence
  Synthetic oligonucleotide
tgagtccctgagcaat

SEQ ID NO: 3911 - DNA, 16 bp, Artificial sequence
  Synthetic oligonucleotide
tctcactgcggaatca

SEQ ID NO: 3912 - DNA, 16 bp, Artificial sequence
  Synthetic oligonucleotide
cgcggagctggccgca

SEQ ID NO: 3913 - DNA, 16 bp, Artificial sequence
  Synthetic oligonucleotide
tgagttcctgcgccat

SEQ ID NO: 3914 - DNA, 16 bp, Artificial sequence
  Synthetic oligonucleotide
ctcaccgaaagtgttg

SEQ ID NO: 3915 - DNA, 16 bp, Artificial sequence
  Synthetic oligonucleotide
ggacccacaggtcatg

SEQ ID NO: 3916 - DNA, 16 bp, Artificial sequence
  Synthetic oligonucleotide
ctccccccgttgtctt

SEQ ID NO: 3917 - DNA, 16 bp, Artificial sequence
  Synthetic oligonucleotide
gactataagtcatagc

SEQ ID NO: 3918 - DNA, 16 bp, Artificial sequence
  Synthetic oligonucleotide
actagactagactgcc

SEQ ID NO: 3919 - DNA, 16 bp, Artificial sequence
  Synthetic oligonucleotide
gatcactctagtgccc

SEQ ID NO: 3920 - DNA, 16 bp, Artificial sequence
  Synthetic oligonucleotide
gacaagctcttgatcc

SEQ ID NO: 3921 - DNA, 16 bp, Artificial sequence
  Synthetic oligonucleotide
aatacctcacatgggt

SEQ ID NO: 3922 - DNA, 16 bp, Artificial sequence
  Synthetic oligonucleotide
ggtaaggtccatctgg

SEQ ID NO: 3923 - DNA, 16 bp, Artificial sequence
  Synthetic oligonucleotide
aaggatagggcaccaa

SEQ ID NO: 3924 - DNA, 16 bp, Artificial sequence
  Synthetic oligonucleotide
ggcaaagtgcacttgc

SEQ ID NO: 3925 - DNA, 16 bp, Artificial sequence
  Synthetic oligonucleotide
cattgatgaatcagca

SEQ ID NO: 3926 - DNA, 16 bp, Artificial sequence
  Synthetic oligonucleotide
cacaagaaggctacct

SEQ ID NO: 3927 - DNA, 16 bp, Artificial sequence
  Synthetic oligonucleotide
gtgcctacttgctgaa

SEQ ID NO: 3928 - DNA, 16 bp, Artificial sequence
  Synthetic oligonucleotide
cagatagctggagtag

SEQ ID NO: 3929 - DNA, 16 bp, Artificial sequence
  Synthetic oligonucleotide
gtacatgtctcccagg

SEQ ID NO: 3930 - DNA, 16 bp, Artificial sequence
  Synthetic oligonucleotide
tggtttacccacctgc

SEQ ID NO: 3931 - DNA, 16 bp, Artificial sequence
  Synthetic oligonucleotide
cagcaacctattctgt

SEQ ID NO: 3932 - DNA, 16 bp, Artificial sequence
  Synthetic oligonucleotide
caggagagtctaggac

SEQ ID NO: 3933 - DNA, 16 bp, Artificial sequence
  Synthetic oligonucleotide
tgggcctaaagacccc

SEQ ID NO: 3934 - DNA, 16 bp, Artificial sequence
  Synthetic oligonucleotide
gcgcaccggcagaagg

SEQ ID NO: 3935 - DNA, 16 bp, Artificial sequence
  Synthetic oligonucleotide
acttcctaacctcccg

SEQ ID NO: 3936 - DNA, 16 bp, Artificial sequence
  Synthetic oligonucleotide
gacggagagcccgcgg

SEQ ID NO: 3937 - DNA, 16 bp, Artificial sequence
  Synthetic oligonucleotide
agacggaggagccgcg

SEQ ID NO: 3938 - DNA, 16 bp, Artificial sequence
  Synthetic oligonucleotide
ccccaatcccgtgttc

SEQ ID NO: 3939 - DNA, 16 bp, Artificial sequence
  Synthetic oligonucleotide
cagagctaacccgggc

SEQ ID NO: 3940 - DNA, 16 bp, Artificial sequence
  Synthetic oligonucleotide
gcccctagcagttgtg

SEQ ID NO: 3941 - DNA, 16 bp, Artificial sequence
  Synthetic oligonucleotide
ccaaagtcgcgggctt

SEQ ID NO: 3942 - DNA, 16 bp, Artificial sequence
  Synthetic oligonucleotide
attctgtaggcacccg

SEQ ID NO: 3943 - DNA, 16 bp, Artificial sequence
  Synthetic oligonucleotide
agagcaagttcgattc

SEQ ID NO: 3944 - DNA, 16 bp, Artificial sequence
  Synthetic oligonucleotide
gtcgcagaacctggct

SEQ ID NO: 3945 - DNA, 16 bp, Artificial sequence
  Synthetic oligonucleotide
atttgaatgggcggag

SEQ ID NO: 3946 - DNA, 16 bp, Artificial sequence
  Synthetic oligonucleotide
ggacgatggacaaagc

SEQ ID NO: 3947 - DNA, 16 bp, Artificial sequence
  Synthetic oligonucleotide
tcctccgcccctgcga

SEQ ID NO: 3948 - DNA, 16 bp, Artificial sequence
  Synthetic oligonucleotide
gagatttgtgcctgac

SEQ ID NO: 3949 - DNA, 16 bp, Artificial sequence
  Synthetic oligonucleotide
cggaatcaccctgggt

SEQ ID NO: 3950 - DNA, 16 bp, Artificial sequence
  Synthetic oligonucleotide
tccctctcatctgctt

SEQ ID NO: 3951 - DNA, 16 bp, Artificial sequence
  Synthetic oligonucleotide
cgcactctccctcctc

SEQ ID NO: 3952 - DNA, 16 bp, Artificial sequence
  Synthetic oligonucleotide
gaacaatcctgggaca

SEQ ID NO: 3953 - DNA, 16 bp, Artificial sequence
  Synthetic oligonucleotide
cctcctagtcacctgg

SEQ ID NO: 3954 - DNA, 16 bp, Artificial sequence
  Synthetic oligonucleotide
atccacccagtctggt

SEQ ID NO: 3955 - DNA, 16 bp, Artificial sequence
  Synthetic oligonucleotide
tcttcttaaggcccat

SEQ ID NO: 3956 - DNA, 16 bp, Artificial sequence
  Synthetic oligonucleotide
ccgatctgttgctagt

SEQ ID NO: 3957 - DNA, 16 bp, Artificial sequence
  Synthetic oligonucleotide
aaggcagggaactgac

SEQ ID NO: 3958 - DNA, 16 bp, Artificial sequence
  Synthetic oligonucleotide
agccaggccacttacc

SEQ ID NO: 3959 - DNA, 16 bp, Artificial sequence
  Synthetic oligonucleotide
actagactgccctgag

SEQ ID NO: 3960 - DNA, 16 bp, Artificial sequence
  Synthetic oligonucleotide
tgggcataagacctag

SEQ ID NO: 3961 - DNA, 16 bp, Artificial sequence
  Synthetic oligonucleotide
tcacacagctcacgat

SEQ ID NO: 3962 - DNA, 16 bp, Artificial sequence
  Synthetic oligonucleotide
acatatctcaagcacc

SEQ ID NO: 3963 - DNA, 16 bp, Artificial sequence
  Synthetic oligonucleotide
tggcatgaatgatgcc

SEQ ID NO: 3964 - DNA, 16 bp, Artificial sequence
  Synthetic oligonucleotide
caagctcttgatcctt

SEQ ID NO: 3965 - DNA, 16 bp, Artificial sequence
  Synthetic oligonucleotide
gtgataaagctgggct

SEQ ID NO: 3966 - DNA, 16 bp, Artificial sequence
  Synthetic oligonucleotide
tggagaactcaaatcc

SEQ ID NO: 3967 - DNA, 16 bp, Artificial sequence
  Synthetic oligonucleotide
ggtttactgttatcaa

SEQ ID NO: 3968 - DNA, 16 bp, Artificial sequence
  Synthetic oligonucleotide
ctgaatacctcacatg

SEQ ID NO: 3969 - DNA, 16 bp, Artificial sequence
  Synthetic oligonucleotide
ttcatctaaaaggtag

SEQ ID NO: 3970 - DNA, 16 bp, Artificial sequence
  Synthetic oligonucleotide
tatggcagagcttgag

SEQ ID NO: 3971 - DNA, 16 bp, Artificial sequence
  Synthetic oligonucleotide
cactctaggtaaattt

SEQ ID NO: 3972 - DNA, 16 bp, Artificial sequence
  Synthetic oligonucleotide
aggcccaccagggtaa

SEQ ID NO: 3973 - DNA, 16 bp, Artificial sequence
  Synthetic oligonucleotide
ccatgcttagagactc

SEQ ID NO: 3974 - DNA, 16 bp, Artificial sequence
  Synthetic oligonucleotide
ttgggtaaggcaagag

SEQ ID NO: 3975 - DNA, 16 bp, Artificial sequence
  Synthetic oligonucleotide
gggattaggcaaggat

SEQ ID NO: 3976 - DNA, 16 bp, Artificial sequence
  Synthetic oligonucleotide
ctgagcatgaagttgt

SEQ ID NO: 3977 - DNA, 16 bp, Artificial sequence
  Synthetic oligonucleotide
atggatctgagatgga

SEQ ID NO: 3978 - DNA, 16 bp, Artificial sequence
  Synthetic oligonucleotide
ggaccaaaccagaact

SEQ ID NO: 3979 - DNA, 16 bp, Artificial sequence
  Synthetic oligonucleotide
tcaaggcaaagtgcac

SEQ ID NO: 3980 - DNA, 16 bp, Artificial sequence
  Synthetic oligonucleotide
tacctgctcaataagc

SEQ ID NO: 3981 - DNA, 16 bp, Artificial sequence
  Synthetic oligonucleotide
cttcagaggaattgtc

SEQ ID NO: 3982 - DNA, 16 bp, Artificial sequence
  Synthetic oligonucleotide
gctagttcaatgttca

SEQ ID NO: 3983 - DNA, 16 bp, Artificial sequence
  Synthetic oligonucleotide
ggaacctaatactgtt

SEQ ID NO: 3984 - DNA, 16 bp, Artificial sequence
  Synthetic oligonucleotide
aaccagattatatgct

SEQ ID NO: 3985 - DNA, 16 bp, Artificial sequence
  Synthetic oligonucleotide
ccatcagcttagcatt

SEQ ID NO: 3986 - DNA, 16 bp, Artificial sequence
  Synthetic oligonucleotide
ttagacacttgattca

SEQ ID NO: 3987 - DNA, 16 bp, Artificial sequence
  Synthetic oligonucleotide
gaagagctgtgtagtt

SEQ ID NO: 3988 - DNA, 16 bp, Artificial sequence
  Synthetic oligonucleotide
gaatgagtgtccttct

SEQ ID NO: 3989 - DNA, 16 bp, Artificial sequence
  Synthetic oligonucleotide
attcccagttaaggtt

SEQ ID NO: 3990 - DNA, 16 bp, Artificial sequence
  Synthetic oligonucleotide
atggccatttgtgggc

SEQ ID NO: 3991 - DNA, 16 bp, Artificial sequence
  Synthetic oligonucleotide
tttgtaactcccaagt

SEQ ID NO: 3992 - DNA, 16 bp, Artificial sequence
  Synthetic oligonucleotide
acattgagaatgtgcc

SEQ ID NO: 3993 - DNA, 16 bp, Artificial sequence
  Synthetic oligonucleotide
tctgatctgagccttg

SEQ ID NO: 3994 - DNA, 16 bp, Artificial sequence
  Synthetic oligonucleotide
cacttgccacaaagta

SEQ ID NO: 3995 - DNA, 16 bp, Artificial sequence
  Synthetic oligonucleotide
gactccacaacctgct

SEQ ID NO: 3996 - DNA, 16 bp, Artificial sequence
  Synthetic oligonucleotide
taaaagttgggttcag

SEQ ID NO: 3997 - DNA, 16 bp, Artificial sequence
  Synthetic oligonucleotide
cctcagggtctggtca

SEQ ID NO: 3998 - DNA, 16 bp, Artificial sequence
  Synthetic oligonucleotide
acttcccctgtactca

SEQ ID NO: 3999 - DNA, 16 bp, Artificial sequence
  Synthetic oligonucleotide
gacagtgagaactgca

SEQ ID NO: 4000 - DNA, 16 bp, Artificial sequence
  Synthetic oligonucleotide
ggacaggcagggtaca

SEQ ID NO: 4001 - DNA, 16 bp, Artificial sequence
  Synthetic oligonucleotide
ccctatcacagtcccc

SEQ ID NO: 4002 - DNA, 16 bp, Artificial sequence
  Synthetic oligonucleotide
aatgaggcgggaggag

SEQ ID NO: 4003 - DNA, 16 bp, Artificial sequence
  Synthetic oligonucleotide
gtccagaatcccaggt

SEQ ID NO: 4004 - DNA, 16 bp, Artificial sequence
  Synthetic oligonucleotide
aaaatgggaccactcc

SEQ ID NO: 4005 - DNA, 16 bp, Artificial sequence
  Synthetic oligonucleotide
ctactccaagtttcca

SEQ ID NO: 4006 - DNA, 16 bp, Artificial sequence
  Synthetic oligonucleotide
gcccttcttgaaccta

SEQ ID NO: 4007 - DNA, 16 bp, Artificial sequence
  Synthetic oligonucleotide
accccgcccaggtcct

SEQ ID NO: 4008 - DNA, 16 bp, Artificial sequence
  Synthetic oligonucleotide
gccaagtctccgagta

SEQ ID NO: 4009 - DNA, 16 bp, Artificial sequence
  Synthetic oligonucleotide
agggatagtggtctca

SEQ ID NO: 4010 - DNA, 16 bp, Artificial sequence
  Synthetic oligonucleotide
agacccccccagagag

SEQ ID NO: 4011 - DNA, 16 bp, Artificial sequence
  Synthetic oligonucleotide
gcccgtcccacctggg

SEQ ID NO: 4012 - DNA, 16 bp, Artificial sequence
  Synthetic oligonucleotide
gcgccgggagcccgga

SEQ ID NO: 4013 - DNA, 16 bp, Artificial sequence
  Synthetic oligonucleotide
gctggccggaatctag

SEQ ID NO: 4014 - DNA, 16 bp, Artificial sequence
  Synthetic oligonucleotide
agccgcggcccctggg

SEQ ID NO: 4015 - DNA, 16 bp, Artificial sequence
  Synthetic oligonucleotide
ccgtgttccagcttcc

SEQ ID NO: 4016 - DNA, 16 bp, Artificial sequence
  Synthetic oligonucleotide
gcgcccccacgcaccc

SEQ ID NO: 4017 - DNA, 16 bp, Artificial sequence
  Synthetic oligonucleotide
gtgatcaaaggtctcc

SEQ ID NO: 4018 - DNA, 16 bp, Artificial sequence
  Synthetic oligonucleotide
caacccatcaggtcag

SEQ ID NO: 4019 - DNA, 16 bp, Artificial sequence
  Synthetic oligonucleotide
ccctgggattctacct

SEQ ID NO: 4020 - DNA, 16 bp, Artificial sequence
  Synthetic oligonucleotide
aaccaagagcaagttc

SEQ ID NO: 4021 - DNA, 16 bp, Artificial sequence
  Synthetic oligonucleotide
gagtcgcagaacctgg

SEQ ID NO: 4022 - DNA, 16 bp, Artificial sequence
  Synthetic oligonucleotide
ccaggatttgaatggg

SEQ ID NO: 4023 - DNA, 16 bp, Artificial sequence
  Synthetic oligonucleotide
taaacccactcatgcc

SEQ ID NO: 4024 - DNA, 16 bp, Artificial sequence
  Synthetic oligonucleotide
acaccccatctgacaa

SEQ ID NO: 4025 - DNA, 16 bp, Artificial sequence
  Synthetic oligonucleotide
gggctaagagctcacc

SEQ ID NO: 4026 - DNA, 16 bp, Artificial sequence
  Synthetic oligonucleotide
ctttccgcactctccc

SEQ ID NO: 4027 - DNA, 16 bp, Artificial sequence
  Synthetic oligonucleotide
ctccctctcatctgct

SEQ ID NO: 4028 - DNA, 16 bp, Artificial sequence
  Synthetic oligonucleotide
agaacaatcctgggac

SEQ ID NO: 4029 - DNA, 16 bp, Artificial sequence
  Synthetic oligonucleotide
gcctcctagtcacctg

SEQ ID NO: 4030 - DNA, 16 bp, Artificial sequence
  Synthetic oligonucleotide
tatccacccagtctgg

SEQ ID NO: 4031 - DNA, 16 bp, Artificial sequence
  Synthetic oligonucleotide
gtcttcttaaggccca

SEQ ID NO: 4032 - DNA, 16 bp, Artificial sequence
  Synthetic oligonucleotide
ctgccaccgatctgtt

SEQ ID NO: 4033 - DNA, 16 bp, Artificial sequence
  Synthetic oligonucleotide
atctacaagggagaga

SEQ ID NO: 4034 - DNA, 16 bp, Artificial sequence
  Synthetic oligonucleotide
gttcccgggaggagga

SEQ ID NO: 4035 - DNA, 16 bp, Artificial sequence
  Synthetic oligonucleotide
agactagactgccctg

SEQ ID NO: 4036 - DNA, 16 bp, Artificial sequence
  Synthetic oligonucleotide
atgggcataagaccta

SEQ ID NO: 4037 - DNA, 16 bp, Artificial sequence
  Synthetic oligonucleotide
gatcacacagctcacg

SEQ ID NO: 4038 - DNA, 16 bp, Artificial sequence
  Synthetic oligonucleotide
cacatatctcaagcac

SEQ ID NO: 4039 - DNA, 16 bp, Artificial sequence
  Synthetic oligonucleotide
gtggcatgaatgatgc

SEQ ID NO: 4040 - DNA, 16 bp, Artificial sequence
  Synthetic oligonucleotide
acaagctcttgatcct

SEQ ID NO: 4041 - DNA, 16 bp, Artificial sequence
  Synthetic oligonucleotide
agtgataaagctgggc

SEQ ID NO: 4042 - DNA, 16 bp, Artificial sequence
  Synthetic oligonucleotide
ttggagaactcaaatc

SEQ ID NO: 4043 - DNA, 16 bp, Artificial sequence
  Synthetic oligonucleotide
aggtttactgttatca

SEQ ID NO: 4044 - DNA, 16 bp, Artificial sequence
  Synthetic oligonucleotide
gctgaatacctcacat

SEQ ID NO: 4045 - DNA, 16 bp, Artificial sequence
  Synthetic oligonucleotide
ccttcatctaaaaggt

SEQ ID NO: 4046 - DNA, 16 bp, Artificial sequence
  Synthetic oligonucleotide
ctatggcagagcttga

SEQ ID NO: 4047 - DNA, 16 bp, Artificial sequence
  Synthetic oligonucleotide
acactctaggtaaatt

SEQ ID NO: 4048 - DNA, 16 bp, Artificial sequence
  Synthetic oligonucleotide
caagtcaggcccacca

SEQ ID NO: 4049 - DNA, 16 bp, Artificial sequence
  Synthetic oligonucleotide
gccatgcttagagact

SEQ ID NO: 4050 - DNA, 16 bp, Artificial sequence
  Synthetic oligonucleotide
tttgggtaaggcaaga

SEQ ID NO: 4051 - DNA, 16 bp, Artificial sequence
  Synthetic oligonucleotide
tggacggacagagagg

SEQ ID NO: 4052 - DNA, 16 bp, Artificial sequence
  Synthetic oligonucleotide
gctgagcatgaagttg

SEQ ID NO: 4053 - DNA, 16 bp, Artificial sequence
  Synthetic oligonucleotide
taggacagtaaatgga

SEQ ID NO: 4054 - DNA, 16 bp, Artificial sequence
  Synthetic oligonucleotide
aggaccaaaccagaac

SEQ ID NO: 4055 - DNA, 16 bp, Artificial sequence
  Synthetic oligonucleotide
gttcaaggcaaagtgc

SEQ ID NO: 4056 - DNA, 16 bp, Artificial sequence
  Synthetic oligonucleotide
gtacctgctcaataag

SEQ ID NO: 4057 - DNA, 16 bp, Artificial sequence
  Synthetic oligonucleotide
aattgcctgtgtcttc

SEQ ID NO: 4058 - DNA, 16 bp, Artificial sequence
  Synthetic oligonucleotide
ttgctagttcaatgtt

SEQ ID NO: 4059 - DNA, 16 bp, Artificial sequence
  Synthetic oligonucleotide
aggaacctaatactgt

SEQ ID NO: 4060 - DNA, 16 bp, Artificial sequence
  Synthetic oligonucleotide
aaaccagattatatgc

SEQ ID NO: 4061 - DNA, 16 bp, Artificial sequence
  Synthetic oligonucleotide
tgccatcagcttagca

SEQ ID NO: 4062 - DNA, 16 bp, Artificial sequence
  Synthetic oligonucleotide
tgttagacacttgatt

SEQ ID NO: 4063 - DNA, 16 bp, Artificial sequence
  Synthetic oligonucleotide
tgaagagctgtgtagt

SEQ ID NO: 4064 - DNA, 16 bp, Artificial sequence
  Synthetic oligonucleotide
tgaatgagtgtccttc

SEQ ID NO: 4065 - DNA, 16 bp, Artificial sequence
  Synthetic oligonucleotide
acattcccagttaagg

SEQ ID NO: 4066 - DNA, 16 bp, Artificial sequence
  Synthetic oligonucleotide
gtcaatacttgaaatg

SEQ ID NO: 4067 - DNA, 16 bp, Artificial sequence
  Synthetic oligonucleotide
atttgtaactcccaag

SEQ ID NO: 4068 - DNA, 16 bp, Artificial sequence
  Synthetic oligonucleotide
tacattgagaatgtgc

SEQ ID NO: 4069 - DNA, 16 bp, Artificial sequence
  Synthetic oligonucleotide
accactctgatctgag

SEQ ID NO: 4070 - DNA, 16 bp, Artificial sequence
  Synthetic oligonucleotide
aagagcacttgccaca

SEQ ID NO: 4071 - DNA, 16 bp, Artificial sequence
  Synthetic oligonucleotide
tagactcctgactcca

SEQ ID NO: 4072 - DNA, 16 bp, Artificial sequence
  Synthetic oligonucleotide
ctaaaagttgggttca

SEQ ID NO: 4073 - DNA, 16 bp, Artificial sequence
  Synthetic oligonucleotide
caactgctcaggcact

SEQ ID NO: 4074 - DNA, 16 bp, Artificial sequence
  Synthetic oligonucleotide
actctctgaggacttc

SEQ ID NO: 4075 - DNA, 16 bp, Artificial sequence
  Synthetic oligonucleotide
cttaccagggctgagg

SEQ ID NO: 4076 - DNA, 16 bp, Artificial sequence
  Synthetic oligonucleotide
aaggacaggcagggta

SEQ ID NO: 4077 - DNA, 16 bp, Artificial sequence
  Synthetic oligonucleotide
tgccctatcacagtcc

SEQ ID NO: 4078 - DNA, 16 bp, Artificial sequence
  Synthetic oligonucleotide
taatgaggcgggagga

SEQ ID NO: 4079 - DNA, 16 bp, Artificial sequence
  Synthetic oligonucleotide
tattgtggagggagag

SEQ ID NO: 4080 - DNA, 16 bp, Artificial sequence
  Synthetic oligonucleotide
caaaatgggaccactc

SEQ ID NO: 4081 - DNA, 16 bp, Artificial sequence
  Synthetic oligonucleotide
tgctactccaagtttc

SEQ ID NO: 4082 - DNA, 16 bp, Artificial sequence
  Synthetic oligonucleotide
ggcccttcttgaacct

SEQ ID NO: 4083 - DNA, 16 bp, Artificial sequence
  Synthetic oligonucleotide
gcaccccgcccaggtc

SEQ ID NO: 4084 - DNA, 16 bp, Artificial sequence
  Synthetic oligonucleotide
catgccaagtctccga

SEQ ID NO: 4085 - DNA, 16 bp, Artificial sequence
  Synthetic oligonucleotide
aaagagggatagtggt

SEQ ID NO: 4086 - DNA, 16 bp, Artificial sequence
  Synthetic oligonucleotide
taaagacccccccaga

SEQ ID NO: 4087 - DNA, 16 bp, Artificial sequence
  Synthetic oligonucleotide
agcccgtcccacctgg

SEQ ID NO: 4088 - DNA, 16 bp, Artificial sequence
  Synthetic oligonucleotide
gtagccacacgacggg

SEQ ID NO: 4089 - DNA, 16 bp, Artificial sequence
  Synthetic oligonucleotide
ggctggccggaatcta

SEQ ID NO: 4090 - DNA, 16 bp, Artificial sequence
  Synthetic oligonucleotide
gagccgcggcccctgg

SEQ ID NO: 4091 - DNA, 16 bp, Artificial sequence
  Synthetic oligonucleotide
atcccgtgttccagct

SEQ ID NO: 4092 - DNA, 16 bp, Artificial sequence
  Synthetic oligonucleotide
ttcccgtccccgcggg

SEQ ID NO: 4093 - DNA, 16 bp, Artificial sequence
  Synthetic oligonucleotide
cagtgatcaaaggtct

SEQ ID NO: 4094 - DNA, 16 bp, Artificial sequence
  Synthetic oligonucleotide
tcacaacccatcaggt

SEQ ID NO: 4095 - DNA, 16 bp, Artificial sequence
  Synthetic oligonucleotide
ggccctgggattctac

SEQ ID NO: 4096 - DNA, 16 bp, Artificial sequence
  Synthetic oligonucleotide
gaaccaagagcaagtt

SEQ ID NO: 4097 - DNA, 16 bp, Artificial sequence
  Synthetic oligonucleotide
catccagagtcgcaga

SEQ ID NO: 4098 - DNA, 16 bp, Artificial sequence
  Synthetic oligonucleotide
gccaggatttgaatgg

SEQ ID NO: 4099 - DNA, 16 bp, Artificial sequence
  Synthetic oligonucleotide
tgtaaacccactcatg

SEQ ID NO: 4100 - DNA, 16 bp, Artificial sequence
  Synthetic oligonucleotide
cacaccccatctgaca

SEQ ID NO: 4101 - DNA, 16 bp, Artificial sequence
  Synthetic oligonucleotide
tgcctgacggcctcgg

SEQ ID NO: 4102 - DNA, 16 bp, Artificial sequence
  Synthetic oligonucleotide
gctttccgcactctcc

SEQ ID NO: 4103 - DNA, 16 bp, Artificial sequence
  Synthetic oligonucleotide
cctgcctccctctcat

SEQ ID NO: 4104 - DNA, 16 bp, Artificial sequence
  Synthetic oligonucleotide
ccagaacaatcctggg

SEQ ID NO: 4105 - DNA, 16 bp, Artificial sequence
  Synthetic oligonucleotide
aggcctcctagtcacc

SEQ ID NO: 4106 - DNA, 16 bp, Artificial sequence
  Synthetic oligonucleotide
cttgtatccacccagt

SEQ ID NO: 4107 - DNA, 16 bp, Artificial sequence
  Synthetic oligonucleotide
ccgttgtcttcttaag

SEQ ID NO: 4108 - DNA, 16 bp, Artificial sequence
  Synthetic oligonucleotide
cctgccaccgatctgt

SEQ ID NO: 4109 - DNA, 16 bp, Artificial sequence
  Synthetic oligonucleotide
aatctacaagggagag

SEQ ID NO: 4110 - DNA, 16 bp, Artificial sequence
  Synthetic oligonucleotide
ggttcccgggaggagg

SEQ ID NO: 4111 - DNA, 16 bp, Artificial sequence
  Synthetic oligonucleotide
cactagactagactgc

SEQ ID NO: 4112 - DNA, 16 bp, Artificial sequence
  Synthetic oligonucleotide
catgggcataagacct

SEQ ID NO: 4113 - DNA, 16 bp, Artificial sequence
  Synthetic oligonucleotide
ccctcaaggatcacac

SEQ ID NO: 4114 - DNA, 16 bp, Artificial sequence
  Synthetic oligonucleotide
cagcacatatctcaag

SEQ ID NO: 4115 - DNA, 16 bp, Artificial sequence
  Synthetic oligonucleotide
ttgaaggccctggcct

SEQ ID NO: 4116 - DNA, 16 bp, Artificial sequence
  Synthetic oligonucleotide
gccagagacaagctct

SEQ ID NO: 4117 - DNA, 16 bp, Artificial sequence
  Synthetic oligonucleotide
cataagtgataaagct

SEQ ID NO: 4118 - DNA, 16 bp, Artificial sequence
  Synthetic oligonucleotide
gaagcttggagaactc

SEQ ID NO: 4119 - DNA, 16 bp, Artificial sequence
  Synthetic oligonucleotide
agaggtttactgttat

SEQ ID NO: 4120 - DNA, 16 bp, Artificial sequence
  Synthetic oligonucleotide
atgggctgaatacctc

SEQ ID NO: 4121 - DNA, 16 bp, Artificial sequence
  Synthetic oligonucleotide
cccttcatctaaaagg

SEQ ID NO: 4122 - DNA, 16 bp, Artificial sequence
  Synthetic oligonucleotide
gctatggcagagcttg

SEQ ID NO: 4123 - DNA, 16 bp, Artificial sequence
  Synthetic oligonucleotide
cacactctaggtaaat

SEQ ID NO: 4124 - DNA, 16 bp, Artificial sequence
  Synthetic oligonucleotide
ccaagtcaggcccacc

SEQ ID NO: 4125 - DNA, 16 bp, Artificial sequence
  Synthetic oligonucleotide
acgccatgcttagaga

SEQ ID NO: 4126 - DNA, 16 bp, Artificial sequence
  Synthetic oligonucleotide
gtttgggtaaggcaag

SEQ ID NO: 4127 - DNA, 16 bp, Artificial sequence
  Synthetic oligonucleotide
tgggatggacggacag

SEQ ID NO: 4128 - DNA, 16 bp, Artificial sequence
  Synthetic oligonucleotide
agctgagcatgaagtt

SEQ ID NO: 4129 - DNA, 16 bp, Artificial sequence
  Synthetic oligonucleotide
ctaggacagtaaatgg

SEQ ID NO: 4130 - DNA, 16 bp, Artificial sequence
  Synthetic oligonucleotide
caaggaccaaaccaga

SEQ ID NO: 4131 - DNA, 16 bp, Artificial sequence
  Synthetic oligonucleotide
tgttcaaggcaaagtg

SEQ ID NO: 4132 - DNA, 16 bp, Artificial sequence
  Synthetic oligonucleotide
gcacaaagtacctgct

SEQ ID NO: 4133 - DNA, 16 bp, Artificial sequence
  Synthetic oligonucleotide
gaattgcctgtgtctt

SEQ ID NO: 4134 - DNA, 16 bp, Artificial sequence
  Synthetic oligonucleotide
tttgctagttcaatgt

SEQ ID NO: 4135 - DNA, 16 bp, Artificial sequence
  Synthetic oligonucleotide
caggaacctaatactg

SEQ ID NO: 4136 - DNA, 16 bp, Artificial sequence
  Synthetic oligonucleotide
gaatcagcaacacata

SEQ ID NO: 4137 - DNA, 16 bp, Artificial sequence
  Synthetic oligonucleotide
agtgccatcagcttag

SEQ ID NO: 4138 - DNA, 16 bp, Artificial sequence
  Synthetic oligonucleotide
gtgttagacacttgat

SEQ ID NO: 4139 - DNA, 16 bp, Artificial sequence
  Synthetic oligonucleotide
gctgaagagctgtgta

SEQ ID NO: 4140 - DNA, 16 bp, Artificial sequence
  Synthetic oligonucleotide
ttgaatgagtgtcctt

SEQ ID NO: 4141 - DNA, 16 bp, Artificial sequence
  Synthetic oligonucleotide
cacattcccagttaag

SEQ ID NO: 4142 - DNA, 16 bp, Artificial sequence
  Synthetic oligonucleotide
caagtcaatacttgaa

SEQ ID NO: 4143 - DNA, 16 bp, Artificial sequence
  Synthetic oligonucleotide
cctacttgctgaattt

SEQ ID NO: 4144 - DNA, 16 bp, Artificial sequence
  Synthetic oligonucleotide
ctacattgagaatgtg

SEQ ID NO: 4145 - DNA, 16 bp, Artificial sequence
  Synthetic oligonucleotide
aaccactctgatctga

SEQ ID NO: 4146 - DNA, 16 bp, Artificial sequence
  Synthetic oligonucleotide
ggaagagcacttgcca

SEQ ID NO: 4147 - DNA, 16 bp, Artificial sequence
  Synthetic oligonucleotide
gtagactcctgactcc

SEQ ID NO: 4148 - DNA, 16 bp, Artificial sequence
  Synthetic oligonucleotide
ctctaaaagttgggtt

SEQ ID NO: 4149 - DNA, 16 bp, Artificial sequence
  Synthetic oligonucleotide
tcaactgctcaggcac

SEQ ID NO: 4150 - DNA, 16 bp, Artificial sequence
  Synthetic oligonucleotide
caacacactctctgag

SEQ ID NO: 4151 - DNA, 16 bp, Artificial sequence
  Synthetic oligonucleotide
tcttaccagggctgag

SEQ ID NO: 4152 - DNA, 16 bp, Artificial sequence
  Synthetic oligonucleotide
cttggacagaaggaca

SEQ ID NO: 4153 - DNA, 16 bp, Artificial sequence
  Synthetic oligonucleotide
ctgccctatcacagtc

SEQ ID NO: 4154 - DNA, 16 bp, Artificial sequence
  Synthetic oligonucleotide
aggagagtaatgaggc

SEQ ID NO: 4155 - DNA, 16 bp, Artificial sequence
  Synthetic oligonucleotide
gtattgtggagggaga

SEQ ID NO: 4156 - DNA, 16 bp, Artificial sequence
  Synthetic oligonucleotide
cctgcaaaatgggacc

SEQ ID NO: 4157 - DNA, 16 bp, Artificial sequence
  Synthetic oligonucleotide
ttgctactccaagttt

SEQ ID NO: 4158 - DNA, 16 bp, Artificial sequence
  Synthetic oligonucleotide
aaggcccttcttgaac

SEQ ID NO: 4159 - DNA, 16 bp, Artificial sequence
  Synthetic oligonucleotide
agcaccccgcccaggt

SEQ ID NO: 4160 - DNA, 16 bp, Artificial sequence
  Synthetic oligonucleotide
ccatgccaagtctccg

SEQ ID NO: 4161 - DNA, 16 bp, Artificial sequence
  Synthetic oligonucleotide
caaagagggatagtgg

SEQ ID NO: 4162 - DNA, 16 bp, Artificial sequence
  Synthetic oligonucleotide
acccctgggcctaaag

SEQ ID NO: 4163 - DNA, 16 bp, Artificial sequence
  Synthetic oligonucleotide
caagcccgtcccacct

SEQ ID NO: 4164 - DNA, 16 bp, Artificial sequence
  Synthetic oligonucleotide
ttcctgtagccacacg

SEQ ID NO: 4165 - DNA, 16 bp, Artificial sequence
  Synthetic oligonucleotide
cggctggccggaatct

SEQ ID NO: 4166 - DNA, 16 bp, Artificial sequence
  Synthetic oligonucleotide
ggagccgcggcccctg

SEQ ID NO: 4167 - DNA, 16 bp, Artificial sequence
  Synthetic oligonucleotide
ctcccgaaccccaatc

SEQ ID NO: 4168 - DNA, 16 bp, Artificial sequence
  Synthetic oligonucleotide
ctcttcccgtccccgc

SEQ ID NO: 4169 - DNA, 16 bp, Artificial sequence
  Synthetic oligonucleotide
acccagtgatcaaagg

SEQ ID NO: 4170 - DNA, 16 bp, Artificial sequence
  Synthetic oligonucleotide
ctcacaacccatcagg

SEQ ID NO: 4171 - DNA, 16 bp, Artificial sequence
  Synthetic oligonucleotide
aggccctgggattcta

SEQ ID NO: 4172 - DNA, 16 bp, Artificial sequence
  Synthetic oligonucleotide
ggaaccaagagcaagt

SEQ ID NO: 4173 - DNA, 16 bp, Artificial sequence
  Synthetic oligonucleotide
ccatccagagtcgcag

SEQ ID NO: 4174 - DNA, 16 bp, Artificial sequence
  Synthetic oligonucleotide
cataggcaaggaggct

SEQ ID NO: 4175 - DNA, 16 bp, Artificial sequence
  Synthetic oligonucleotide
aagctgctccaggcgc

SEQ ID NO: 4176 - DNA, 16 bp, Artificial sequence
  Synthetic oligonucleotide
cgccttcttcacaccc

SEQ ID NO: 4177 - DNA, 16 bp, Artificial sequence
  Synthetic oligonucleotide
gtgcctgacggcctcg

SEQ ID NO: 4178 - DNA, 16 bp, Artificial sequence
  Synthetic oligonucleotide
cactcaccgaaagtgt

SEQ ID NO: 4179 - DNA, 16 bp, Artificial sequence
  Synthetic oligonucleotide
cccccagaacaatcct

SEQ ID NO: 4180 - DNA, 16 bp, Artificial sequence
  Synthetic oligonucleotide
ataggcctcctagtca

SEQ ID NO: 4181 - DNA, 16 bp, Artificial sequence
  Synthetic oligonucleotide
ccttgtatccacccag

SEQ ID NO: 4182 - DNA, 16 bp, Artificial sequence
  Synthetic oligonucleotide
cccgttgtcttcttaa

SEQ ID NO: 4183 - DNA, 16 bp, Artificial sequence
  Synthetic oligonucleotide
tagcctgccaccgatc

SEQ ID NO: 4184 - DNA, 16 bp, Artificial sequence
  Synthetic oligonucleotide
gaatctacaagggaga

SEQ ID NO: 4185 - DNA, 16 bp, Artificial sequence
  Synthetic oligonucleotide
ccacccaagggttccc

SEQ ID NO: 4186 - DNA, 16 bp, Artificial sequence
  Synthetic oligonucleotide
taggcactagactaga

SEQ ID NO: 4187 - DNA, 16 bp, Artificial sequence
  Synthetic oligonucleotide
ccatgggcataagacc

SEQ ID NO: 4188 - DNA, 16 bp, Artificial sequence
  Synthetic oligonucleotide
tgccctcaaggatcac

SEQ ID NO: 4189 - DNA, 16 bp, Artificial sequence
  Synthetic oligonucleotide
agcagcacatatctca

SEQ ID NO: 4190 - DNA, 16 bp, Artificial sequence
  Synthetic oligonucleotide
attgaaggccctggcc

SEQ ID NO: 4191 - DNA, 16 bp, Artificial sequence
  Synthetic oligonucleotide
tgccagagacaagctc

SEQ ID NO: 4192 - DNA, 16 bp, Artificial sequence
  Synthetic oligonucleotide
ctcataagtgataaag

SEQ ID NO: 4193 - DNA, 16 bp, Artificial sequence
  Synthetic oligonucleotide
ttgaagcttggagaac

SEQ ID NO: 4194 - DNA, 16 bp, Artificial sequence
  Synthetic oligonucleotide
aagaggtttactgtta

SEQ ID NO: 4195 - DNA, 16 bp, Artificial sequence
  Synthetic oligonucleotide
gatgggctgaatacct

SEQ ID NO: 4196 - DNA, 16 bp, Artificial sequence
  Synthetic oligonucleotide
acccttcatctaaaag

SEQ ID NO: 4197 - DNA, 16 bp, Artificial sequence
  Synthetic oligonucleotide
agctatggcagagctt

SEQ ID NO: 4198 - DNA, 16 bp, Artificial sequence
  Synthetic oligonucleotide
ccacactctaggtaaa

SEQ ID NO: 4199 - DNA, 16 bp, Artificial sequence
  Synthetic oligonucleotide
accaagtcaggcccac

SEQ ID NO: 4200 - DNA, 16 bp, Artificial sequence
  Synthetic oligonucleotide
ttggaatgtgctgggc

SEQ ID NO: 4201 - DNA, 16 bp, Artificial sequence
  Synthetic oligonucleotide
agtttgggtaaggcaa

SEQ ID NO: 4202 - DNA, 16 bp, Artificial sequence
  Synthetic oligonucleotide
agatgggatggacgga

SEQ ID NO: 4203 - DNA, 16 bp, Artificial sequence
  Synthetic oligonucleotide
tagctgagcatgaagt

SEQ ID NO: 4204 - DNA, 16 bp, Artificial sequence
  Synthetic oligonucleotide
actaggacagtaaatg

SEQ ID NO: 4205 - DNA, 16 bp, Artificial sequence
  Synthetic oligonucleotide
ccaaggaccaaaccag

SEQ ID NO: 4206 - DNA, 16 bp, Artificial sequence
  Synthetic oligonucleotide
agcttttgccactatt

SEQ ID NO: 4207 - DNA, 16 bp, Artificial sequence
  Synthetic oligonucleotide
ggcacaaagtacctgc

SEQ ID NO: 4208 - DNA, 16 bp, Artificial sequence
  Synthetic oligonucleotide
gagaattgcctgtgtc

SEQ ID NO: 4209 - DNA, 16 bp, Artificial sequence
  Synthetic oligonucleotide
tgtttgctagttcaat

SEQ ID NO: 4210 - DNA, 16 bp, Artificial sequence
  Synthetic oligonucleotide
acaggaacctaatact

SEQ ID NO: 4211 - DNA, 16 bp, Artificial sequence
  Synthetic oligonucleotide
tgatgaatcagcaaca

SEQ ID NO: 4212 - DNA, 16 bp, Artificial sequence
  Synthetic oligonucleotide
atagtgccatcagctt

SEQ ID NO: 4213 - DNA, 16 bp, Artificial sequence
  Synthetic oligonucleotide
gtgtgttagacacttg

SEQ ID NO: 4214 - DNA, 16 bp, Artificial sequence
  Synthetic oligonucleotide
aatggcctctgagcct

SEQ ID NO: 4215 - DNA, 16 bp, Artificial sequence
  Synthetic oligonucleotide
attgaatgagtgtcct

SEQ ID NO: 4216 - DNA, 16 bp, Artificial sequence
  Synthetic oligonucleotide
gcacattcccagttaa

SEQ ID NO: 4217 - DNA, 16 bp, Artificial sequence
  Synthetic oligonucleotide
ccaagtcaatacttga

SEQ ID NO: 4218 - DNA, 16 bp, Artificial sequence
  Synthetic oligonucleotide
gcctacttgctgaatt

SEQ ID NO: 4219 - DNA, 16 bp, Artificial sequence
  Synthetic oligonucleotide
tggttctacattgaga

SEQ ID NO: 4220 - DNA, 16 bp, Artificial sequence
  Synthetic oligonucleotide
taaccactctgatctg

SEQ ID NO: 4221 - DNA, 16 bp, Artificial sequence
  Synthetic oligonucleotide
aggaagagcacttgcc

SEQ ID NO: 4222 - DNA, 16 bp, Artificial sequence
  Synthetic oligonucleotide
agtagactcctgactc

SEQ ID NO: 4223 - DNA, 16 bp, Artificial sequence
  Synthetic oligonucleotide
ctgctctaaaagttgg

SEQ ID NO: 4224 - DNA, 16 bp, Artificial sequence
  Synthetic oligonucleotide
ctcaactgctcaggca

SEQ ID NO: 4225 - DNA, 16 bp, Artificial sequence
  Synthetic oligonucleotide
acaacacactctctga

SEQ ID NO: 4226 - DNA, 16 bp, Artificial sequence
  Synthetic oligonucleotide
gtcttaccagggctga

SEQ ID NO: 4227 - DNA, 16 bp, Artificial sequence
  Synthetic oligonucleotide
ccttggacagaaggac

SEQ ID NO: 4228 - DNA, 16 bp, Artificial sequence
  Synthetic oligonucleotide
cctgccctatcacagt

SEQ ID NO: 4229 - DNA, 16 bp, Artificial sequence
  Synthetic oligonucleotide
ccaggagagtaatgag

SEQ ID NO: 4230 - DNA, 16 bp, Artificial sequence
  Synthetic oligonucleotide
ggtattgtggagggag

SEQ ID NO: 4231 - DNA, 16 bp, Artificial sequence
  Synthetic oligonucleotide
gtttacccacctgcaa

SEQ ID NO: 4232 - DNA, 16 bp, Artificial sequence
  Synthetic oligonucleotide
cttgctactccaagtt

SEQ ID NO: 4233 - DNA, 16 bp, Artificial sequence
  Synthetic oligonucleotide
gccaaggcccttcttg

SEQ ID NO: 4234 - DNA, 16 bp, Artificial sequence
  Synthetic oligonucleotide
gcccagggttgcccct

SEQ ID NO: 4235 - DNA, 16 bp, Artificial sequence
  Synthetic oligonucleotide
accatgccaagtctcc

SEQ ID NO: 4236 - DNA, 16 bp, Artificial sequence
  Synthetic oligonucleotide
acaaagagggatagtg

SEQ ID NO: 4237 - DNA, 16 bp, Artificial sequence
  Synthetic oligonucleotide
ccacccctgggcctaa

SEQ ID NO: 4238 - DNA, 16 bp, Artificial sequence
  Synthetic oligonucleotide
gcaagcccgtcccacc

SEQ ID NO: 4239 - DNA, 16 bp, Artificial sequence
  Synthetic oligonucleotide
gttcctgtagccacac

SEQ ID NO: 4240 - DNA, 16 bp, Artificial sequence
  Synthetic oligonucleotide
ggccggctggccggaa

SEQ ID NO: 4241 - DNA, 16 bp, Artificial sequence
  Synthetic oligonucleotide
aggagccgcggcccct

SEQ ID NO: 4242 - DNA, 16 bp, Artificial sequence
  Synthetic oligonucleotide
tgctcccgaaccccaa

SEQ ID NO: 4243 - DNA, 16 bp, Artificial sequence
  Synthetic oligonucleotide
caagctctcttcccgt

SEQ ID NO: 4244 - DNA, 16 bp, Artificial sequence
  Synthetic oligonucleotide
ctaacccagtgatcaa

SEQ ID NO: 4245 - DNA, 16 bp, Artificial sequence
  Synthetic oligonucleotide
attctcacaacccatc

SEQ ID NO: 4246 - DNA, 16 bp, Artificial sequence
  Synthetic oligonucleotide
gtgaatcccaggccct

SEQ ID NO: 4247 - DNA, 16 bp, Artificial sequence
  Synthetic oligonucleotide
cgcccagagggaacca

SEQ ID NO: 4248 - DNA, 16 bp, Artificial sequence
  Synthetic oligonucleotide
cccatccagagtcgca

SEQ ID NO: 4249 - DNA, 16 bp, Artificial sequence
  Synthetic oligonucleotide
tcataggcaaggaggc

SEQ ID NO: 4250 - DNA, 16 bp, Artificial sequence
  Synthetic oligonucleotide
aaagctgctccaggcg

SEQ ID NO: 4251 - DNA, 16 bp, Artificial sequence
  Synthetic oligonucleotide
gcgccttcttcacacc

SEQ ID NO: 4252 - DNA, 16 bp, Artificial sequence
  Synthetic oligonucleotide
atttgtgcctgacggc

SEQ ID NO: 4253 - DNA, 16 bp, Artificial sequence
  Synthetic oligonucleotide
ctgctttccgcactct

SEQ ID NO: 4254 - DNA, 16 bp, Artificial sequence
  Synthetic oligonucleotide
ccacagcactcaccga

SEQ ID NO: 4255 - DNA, 16 bp, Artificial sequence
  Synthetic oligonucleotide
ccccccagaacaatcc

SEQ ID NO: 4256 - DNA, 16 bp, Artificial sequence
  Synthetic oligonucleotide
ctttccacataggcct

SEQ ID NO: 4257 - DNA, 16 bp, Artificial sequence
  Synthetic oligonucleotide
cccttgtatccaccca

SEQ ID NO: 4258 - DNA, 16 bp, Artificial sequence
  Synthetic oligonucleotide
ctacctccccccgttg

SEQ ID NO: 4259 - DNA, 16 bp, Artificial sequence
  Synthetic oligonucleotide
atagcctgccaccgat

SEQ ID NO: 4260 - DNA, 16 bp, Artificial sequence
  Synthetic oligonucleotide
gtggaatctacaaggg

SEQ ID NO: 4261 - DNA, 16 bp, Artificial sequence
  Synthetic oligonucleotide
cccacccaagggttcc

SEQ ID NO: 4262 - DNA, 16 bp, Artificial sequence
  Synthetic oligonucleotide
caccaggtaggcacta

SEQ ID NO: 4263 - DNA, 16 bp, Artificial sequence
  Synthetic oligonucleotide
tgcccatgggcataag

SEQ ID NO: 4264 - DNA, 16 bp, Artificial sequence
  Synthetic oligonucleotide
agcccataccctgccc

SEQ ID NO: 4265 - DNA, 16 bp, Artificial sequence
  Synthetic oligonucleotide
cagcagcacatatctc

SEQ ID NO: 4266 - DNA, 16 bp, Artificial sequence
  Synthetic oligonucleotide
cattgaaggccctggc

SEQ ID NO: 4267 - DNA, 16 bp, Artificial sequence
  Synthetic oligonucleotide
atgccagagacaagct

SEQ ID NO: 4268 - DNA, 16 bp, Artificial sequence
  Synthetic oligonucleotide
gctcataagtgataaa

SEQ ID NO: 4269 - DNA, 16 bp, Artificial sequence
  Synthetic oligonucleotide
caacctggtttcacag

SEQ ID NO: 4270 - DNA, 16 bp, Artificial sequence
  Synthetic oligonucleotide
taagaggtttactgtt

SEQ ID NO: 4271 - DNA, 16 bp, Artificial sequence
  Synthetic oligonucleotide
ggtgatgggctgaata

SEQ ID NO: 4272 - DNA, 16 bp, Artificial sequence
  Synthetic oligonucleotide
tacccttcatctaaaa

SEQ ID NO: 4273 - DNA, 16 bp, Artificial sequence
  Synthetic oligonucleotide
gagctatggcagagct

SEQ ID NO: 4274 - DNA, 16 bp, Artificial sequence
  Synthetic oligonucleotide
tgctatgtgccacact

SEQ ID NO: 4275 - DNA, 16 bp, Artificial sequence
  Synthetic oligonucleotide
cccaccaagtcaggcc

SEQ ID NO: 4276 - DNA, 16 bp, Artificial sequence
  Synthetic oligonucleotide
gttggaatgtgctggg

SEQ ID NO: 4277 - DNA, 16 bp, Artificial sequence
  Synthetic oligonucleotide
aagtttgggtaaggca

SEQ ID NO: 4278 - DNA, 16 bp, Artificial sequence
  Synthetic oligonucleotide
cagatgggatggacgg

SEQ ID NO: 4279 - DNA, 16 bp, Artificial sequence
  Synthetic oligonucleotide
ttaagatgcaaatggg

SEQ ID NO: 4280 - DNA, 16 bp, Artificial sequence
  Synthetic oligonucleotide
gaactaggacagtaaa

SEQ ID NO: 4281 - DNA, 16 bp, Artificial sequence
  Synthetic oligonucleotide
gccaaggaccaaacca

SEQ ID NO: 4282 - DNA, 16 bp, Artificial sequence
  Synthetic oligonucleotide
aagcttttgccactat

SEQ ID NO: 4283 - DNA, 16 bp, Artificial sequence
  Synthetic oligonucleotide
tggcacaaagtacctg

SEQ ID NO: 4284 - DNA, 16 bp, Artificial sequence
  Synthetic oligonucleotide
tgagaattgcctgtgt

SEQ ID NO: 4285 - DNA, 16 bp, Artificial sequence
  Synthetic oligonucleotide
ctgtttgctagttcaa

SEQ ID NO: 4286 - DNA, 16 bp, Artificial sequence
  Synthetic oligonucleotide
tcacaggaacctaata

SEQ ID NO: 4287 - DNA, 16 bp, Artificial sequence
  Synthetic oligonucleotide
ttgatgaatcagcaac

SEQ ID NO: 4288 - DNA, 16 bp, Artificial sequence
  Synthetic oligonucleotide
tgctatagtgccatca

SEQ ID NO: 4289 - DNA, 16 bp, Artificial sequence
  Synthetic oligonucleotide
gctaccttagggagaa

SEQ ID NO: 4290 - DNA, 16 bp, Artificial sequence
  Synthetic oligonucleotide
gaaatggcctctgagc

SEQ ID NO: 4291 - DNA, 16 bp, Artificial sequence
  Synthetic oligonucleotide
ctctcctattgaatga

SEQ ID NO: 4292 - DNA, 16 bp, Artificial sequence
  Synthetic oligonucleotide
ttgcacattcccagtt

SEQ ID NO: 4293 - DNA, 16 bp, Artificial sequence
  Synthetic oligonucleotide
cccaagtcaatacttg

SEQ ID NO: 4294 - DNA, 16 bp, Artificial sequence
  Synthetic oligonucleotide
tgcctacttgctgaat

SEQ ID NO: 4295 - DNA, 16 bp, Artificial sequence
  Synthetic oligonucleotide
ctggttctacattgag

SEQ ID NO: 4296 - DNA, 16 bp, Artificial sequence
  Synthetic oligonucleotide
gttaaccactctgatc

SEQ ID NO: 4297 - DNA, 16 bp, Artificial sequence
  Synthetic oligonucleotide
aagtcttcagtcccaa

SEQ ID NO: 4298 - DNA, 16 bp, Artificial sequence
  Synthetic oligonucleotide
tggagtagactcctga

SEQ ID NO: 4299 - DNA, 16 bp, Artificial sequence
  Synthetic oligonucleotide
accctcaaaaaggtcg

SEQ ID NO: 4300 - DNA, 16 bp, Artificial sequence
  Synthetic oligonucleotide
actcaactgctcaggc

SEQ ID NO: 4301 - DNA, 16 bp, Artificial sequence
  Synthetic oligonucleotide
gacaacacactctctg

SEQ ID NO: 4302 - DNA, 16 bp, Artificial sequence
  Synthetic oligonucleotide
agtcttaccagggctg

SEQ ID NO: 4303 - DNA, 16 bp, Artificial sequence
  Synthetic oligonucleotide
gttccttggacagaag

SEQ ID NO: 4304 - DNA, 16 bp, Artificial sequence
  Synthetic oligonucleotide
accctgccctatcaca

SEQ ID NO: 4305 - DNA, 16 bp, Artificial sequence
  Synthetic oligonucleotide
accaggagagtaatga

SEQ ID NO: 4306 - DNA, 16 bp, Artificial sequence
  Synthetic oligonucleotide
aagggtattgtggagg

SEQ ID NO: 4307 - DNA, 16 bp, Artificial sequence
  Synthetic oligonucleotide
cttggtttacccacct

SEQ ID NO: 4308 - DNA, 16 bp, Artificial sequence
  Synthetic oligonucleotide
gaccttgctactccaa

SEQ ID NO: 4309 - DNA, 16 bp, Artificial sequence
  Synthetic oligonucleotide
ggccaaggcccttctt

SEQ ID NO: 4310 - DNA, 16 bp, Artificial sequence
  Synthetic oligonucleotide
taggcccagggttgcc

SEQ ID NO: 4311 - DNA, 16 bp, Artificial sequence
  Synthetic oligonucleotide
gaccatgccaagtctc

SEQ ID NO: 4312 - DNA, 16 bp, Artificial sequence
  Synthetic oligonucleotide
gttcccaaccatctgc

SEQ ID NO: 4313 - DNA, 16 bp, Artificial sequence
  Synthetic oligonucleotide
agtgagccacccctgg

SEQ ID NO: 4314 - DNA, 16 bp, Artificial sequence
  Synthetic oligonucleotide
ttcctggcaagcccgt

SEQ ID NO: 4315 - DNA, 16 bp, Artificial sequence
  Synthetic oligonucleotide
ccgggttcctgtagcc

SEQ ID NO: 4316 - DNA, 16 bp, Artificial sequence
  Synthetic oligonucleotide
gcggccggctggccgg

SEQ ID NO: 4317 - DNA, 16 bp, Artificial sequence
  Synthetic oligonucleotide
gaggagccgcggcccc

SEQ ID NO: 4318 - DNA, 16 bp, Artificial sequence
  Synthetic oligonucleotide
ctgctcccgaacccca

SEQ ID NO: 4319 - DNA, 16 bp, Artificial sequence
  Synthetic oligonucleotide
ccaagctctcttcccg

SEQ ID NO: 4320 - DNA, 16 bp, Artificial sequence
  Synthetic oligonucleotide
cctaacccagtgatca

SEQ ID NO: 4321 - DNA, 16 bp, Artificial sequence
  Synthetic oligonucleotide
tcacctacacattctc

SEQ ID NO: 4322 - DNA, 16 bp, Artificial sequence
  Synthetic oligonucleotide
agtgaatcccaggccc

SEQ ID NO: 4323 - DNA, 16 bp, Artificial sequence
  Synthetic oligonucleotide
gcgcccagagggaacc

SEQ ID NO: 4324 - DNA, 16 bp, Artificial sequence
  Synthetic oligonucleotide
cacccatccagagtcg

SEQ ID NO: 4325 - DNA, 16 bp, Artificial sequence
  Synthetic oligonucleotide
ttcataggcaaggagg

SEQ ID NO: 4326 - DNA, 16 bp, Artificial sequence
  Synthetic oligonucleotide
gacaaagctgctccag

SEQ ID NO: 4327 - DNA, 16 bp, Artificial sequence
  Synthetic oligonucleotide
cctgcgaacacagagc

SEQ ID NO: 4328 - DNA, 16 bp, Artificial sequence
  Synthetic oligonucleotide
tgagatttgtgcctga

SEQ ID NO: 4329 - DNA, 16 bp, Artificial sequence
  Synthetic oligonucleotide
tctgctttccgcactc

SEQ ID NO: 4330 - DNA, 16 bp, Artificial sequence
  Synthetic oligonucleotide
caatcctggttcccac

SEQ ID NO: 4331 - DNA, 16 bp, Artificial sequence
  Synthetic oligonucleotide
catggctgtgatagcg

SEQ ID NO: 4332 - DNA, 16 bp, Artificial sequence
  Synthetic oligonucleotide
acctttccacataggc

SEQ ID NO: 4333 - DNA, 16 bp, Artificial sequence
  Synthetic oligonucleotide
tgcccttgtatccacc

SEQ ID NO: 4334 - DNA, 16 bp, Artificial sequence
  Synthetic oligonucleotide
ccaaaccctttctacc

SEQ ID NO: 4335 - DNA, 16 bp, Artificial sequence
  Synthetic oligonucleotide
catagcctgccaccga

SEQ ID NO: 4336 - DNA, 16 bp, Artificial sequence
  Synthetic oligonucleotide
aggtggaatctacaag

SEQ ID NO: 4337 - DNA, 16 bp, Artificial sequence
  Synthetic oligonucleotide
ccccacccaagggttc

SEQ ID NO: 4338 - DNA, 16 bp, Artificial sequence
  Synthetic oligonucleotide
gcaccaggtaggcact

SEQ ID NO: 4339 - DNA, 16 bp, Artificial sequence
  Synthetic oligonucleotide
cactctagtgcccatg

SEQ ID NO: 4340 - DNA, 16 bp, Artificial sequence
  Synthetic oligonucleotide
acttagacacagccca

SEQ ID NO: 4341 - DNA, 16 bp, Artificial sequence
  Synthetic oligonucleotide
gcgccagcagcacata

SEQ ID NO: 4342 - DNA, 16 bp, Artificial sequence
  Synthetic oligonucleotide
ccattgaaggccctgg

SEQ ID NO: 4343 - DNA, 16 bp, Artificial sequence
  Synthetic oligonucleotide
gatgccagagacaagc

SEQ ID NO: 4344 - DNA, 16 bp, Artificial sequence
  Synthetic oligonucleotide
agctcataagtgataa

SEQ ID NO: 4345 - DNA, 16 bp, Artificial sequence
  Synthetic oligonucleotide
tatcaacctggtttca

SEQ ID NO: 4346 - DNA, 16 bp, Artificial sequence
  Synthetic oligonucleotide
ctaagaggtttactgt

SEQ ID NO: 4347 - DNA, 16 bp, Artificial sequence
  Synthetic oligonucleotide
gcaccaggtgatgggc

SEQ ID NO: 4348 - DNA, 16 bp, Artificial sequence
  Synthetic oligonucleotide
ggtacccttcatctaa

SEQ ID NO: 4349 - DNA, 16 bp, Artificial sequence
  Synthetic oligonucleotide
atttagtgtctggaag

SEQ ID NO: 4350 - DNA, 16 bp, Artificial sequence
  Synthetic oligonucleotide
gttcacaggccctgct

SEQ ID NO: 4351 - DNA, 16 bp, Artificial sequence
  Synthetic oligonucleotide
ccccaccaagtcaggc

SEQ ID NO: 4352 - DNA, 16 bp, Artificial sequence
  Synthetic oligonucleotide
agggttggaatgtgct

SEQ ID NO: 4353 - DNA, 16 bp, Artificial sequence
  Synthetic oligonucleotide
accaagtttgggtaag

SEQ ID NO: 4354 - DNA, 16 bp, Artificial sequence
  Synthetic oligonucleotide
tgcagatgggatggac

SEQ ID NO: 4355 - DNA, 16 bp, Artificial sequence
  Synthetic oligonucleotide
gacctttaagatgcaa

SEQ ID NO: 4356 - DNA, 16 bp, Artificial sequence
  Synthetic oligonucleotide
agaactaggacagtaa

SEQ ID NO: 4357 - DNA, 16 bp, Artificial sequence
  Synthetic oligonucleotide
ttgccaaggaccaaac

SEQ ID NO: 4358 - DNA, 16 bp, Artificial sequence
  Synthetic oligonucleotide
taagcttttgccacta

SEQ ID NO: 4359 - DNA, 16 bp, Artificial sequence
  Synthetic oligonucleotide
ctggcacaaagtacct

SEQ ID NO: 4360 - DNA, 16 bp, Artificial sequence
  Synthetic oligonucleotide
atgagaattgcctgtg

SEQ ID NO: 4361 - DNA, 16 bp, Artificial sequence
  Synthetic oligonucleotide
actgtttgctagttca

SEQ ID NO: 4362 - DNA, 16 bp, Artificial sequence
  Synthetic oligonucleotide
ctgttggttgatgaaa

SEQ ID NO: 4363 - DNA, 16 bp, Artificial sequence
  Synthetic oligonucleotide
attgatgaatcagcaa

SEQ ID NO: 4364 - DNA, 16 bp, Artificial sequence
  Synthetic oligonucleotide
gtgctatagtgccatc

SEQ ID NO: 4365 - DNA, 16 bp, Artificial sequence
  Synthetic oligonucleotide
ggctaccttagggaga

SEQ ID NO: 4366 - DNA, 16 bp, Artificial sequence
  Synthetic oligonucleotide
gcttttggaaatggcc

SEQ ID NO: 4367 - DNA, 16 bp, Artificial sequence
  Synthetic oligonucleotide
ctgctgcttgtttcag

SEQ ID NO: 4368 - DNA, 16 bp, Artificial sequence
  Synthetic oligonucleotide
aatttgcacattccca

SEQ ID NO: 4369 - DNA, 16 bp, Artificial sequence
  Synthetic oligonucleotide
tcccaagtcaatactt

SEQ ID NO: 4370 - DNA, 16 bp, Artificial sequence
  Synthetic oligonucleotide
atgtgcctacttgctg

SEQ ID NO: 4371 - DNA, 16 bp, Artificial sequence
  Synthetic oligonucleotide
ctctggttctacattg

SEQ ID NO: 4372 - DNA, 16 bp, Artificial sequence
  Synthetic oligonucleotide
tgttaaccactctgat

SEQ ID NO: 4373 - DNA, 16 bp, Artificial sequence
  Synthetic oligonucleotide
taagtcttcagtccca

SEQ ID NO: 4374 - DNA, 16 bp, Artificial sequence
  Synthetic oligonucleotide
tcagatagctggagta

SEQ ID NO: 4375 - DNA, 16 bp, Artificial sequence
  Synthetic oligonucleotide
gaccctcaaaaaggtc

SEQ ID NO: 4376 - DNA, 16 bp, Artificial sequence
  Synthetic oligonucleotide
tactcaactgctcagg

SEQ ID NO: 4377 - DNA, 16 bp, Artificial sequence
  Synthetic oligonucleotide
ggacaacacactctct

SEQ ID NO: 4378 - DNA, 16 bp, Artificial sequence
  Synthetic oligonucleotide
cgtagtcttaccaggg

SEQ ID NO: 4379 - DNA, 16 bp, Artificial sequence
  Synthetic oligonucleotide
gcagagttccttggac

SEQ ID NO: 4380 - DNA, 16 bp, Artificial sequence
  Synthetic oligonucleotide
gcccaccctgccctat

SEQ ID NO: 4381 - DNA, 16 bp, Artificial sequence
  Synthetic oligonucleotide
taccaggagagtaatg

SEQ ID NO: 4382 - DNA, 16 bp, Artificial sequence
  Synthetic oligonucleotide
aaagggtattgtggag

SEQ ID NO: 4383 - DNA, 16 bp, Artificial sequence
  Synthetic oligonucleotide
caagcttggtttaccc

SEQ ID NO: 4384 - DNA, 16 bp, Artificial sequence
  Synthetic oligonucleotide
tacttgccttgtgacc

SEQ ID NO: 4385 - DNA, 16 bp, Artificial sequence
  Synthetic oligonucleotide
gggccaaggcccttct

SEQ ID NO: 4386 - DNA, 16 bp, Artificial sequence
  Synthetic oligonucleotide
gtaggcccagggttgc

SEQ ID NO: 4387 - DNA, 16 bp, Artificial sequence
  Synthetic oligonucleotide
taggaccatgccaagt

SEQ ID NO: 4388 - DNA, 16 bp, Artificial sequence
  Synthetic oligonucleotide
ccgttcccaaccatct

SEQ ID NO: 4389 - DNA, 16 bp, Artificial sequence
  Synthetic oligonucleotide
ggaacgcagtgagcca

SEQ ID NO: 4390 - DNA, 16 bp, Artificial sequence
  Synthetic oligonucleotide
cttcctggcaagcccg

SEQ ID NO: 4391 - DNA, 16 bp, Artificial sequence
  Synthetic oligonucleotide
gttgtccgggttcctg

SEQ ID NO: 4392 - DNA, 16 bp, Artificial sequence
  Synthetic oligonucleotide
ccgcggccggctggcc

SEQ ID NO: 4393 - DNA, 16 bp, Artificial sequence
  Synthetic oligonucleotide
ggagacggaggagccg

SEQ ID NO: 4394 - DNA, 16 bp, Artificial sequence
  Synthetic oligonucleotide
agccccctgctcccga

SEQ ID NO: 4395 - DNA, 16 bp, Artificial sequence
  Synthetic oligonucleotide
gggccccaagctctct

SEQ ID NO: 4396 - DNA, 16 bp, Artificial sequence
  Synthetic oligonucleotide
cttccgcctaacccag

SEQ ID NO: 4397 - DNA, 16 bp, Artificial sequence
  Synthetic oligonucleotide
gattcacctacacatt

SEQ ID NO: 4398 - DNA, 16 bp, Artificial sequence
  Synthetic oligonucleotide
agcagtgaatcccagg

SEQ ID NO: 4399 - DNA, 16 bp, Artificial sequence
  Synthetic oligonucleotide
ggcctttgcagcccgg

SEQ ID NO: 4400 - DNA, 16 bp, Artificial sequence
  Synthetic oligonucleotide
ccacccatccagagtc

SEQ ID NO: 4401 - DNA, 16 bp, Artificial sequence
  Synthetic oligonucleotide
gtgccattaattcaat

SEQ ID NO: 4402 - DNA, 16 bp, Artificial sequence
  Synthetic oligonucleotide
ggacaaagctgctcca

SEQ ID NO: 4403 - DNA, 16 bp, Artificial sequence
  Synthetic oligonucleotide
cgcccctgcgaacaca

SEQ ID NO: 4404 - DNA, 16 bp, Artificial sequence
  Synthetic oligonucleotide
ctgagatttgtgcctg

SEQ ID NO: 4405 - DNA, 16 bp, Artificial sequence
  Synthetic oligonucleotide
catctgctttccgcac

SEQ ID NO: 4406 - DNA, 16 bp, Artificial sequence
  Synthetic oligonucleotide
acaatcctggttccca

SEQ ID NO: 4407 - DNA, 16 bp, Artificial sequence
  Synthetic oligonucleotide
ggtcatgagcagaggc

SEQ ID NO: 4408 - DNA, 16 bp, Artificial sequence
  Synthetic oligonucleotide
tcacctttccacatag

SEQ ID NO: 4409 - DNA, 16 bp, Artificial sequence
  Synthetic oligonucleotide
atctcccccagaaatg

SEQ ID NO: 4410 - DNA, 16 bp, Artificial sequence
  Synthetic oligonucleotide
cccaaaccctttctac

SEQ ID NO: 4411 - DNA, 16 bp, Artificial sequence
  Synthetic oligonucleotide
gtcatagcctgccacc

SEQ ID NO: 4412 - DNA, 16 bp, Artificial sequence
  Synthetic oligonucleotide
aaggtggaatctacaa

SEQ ID NO: 4413 - DNA, 16 bp, Artificial sequence
  Synthetic oligonucleotide
atccccacccaagggt

SEQ ID NO: 4414 - DNA, 16 bp, Artificial sequence
  Synthetic oligonucleotide
agcaccaggtaggcac

SEQ ID NO: 4415 - DNA, 16 bp, Artificial sequence
  Synthetic oligonucleotide
atcactctagtgccca

SEQ ID NO: 4416 - DNA, 16 bp, Artificial sequence
  Synthetic oligonucleotide
cacttagacacagccc

SEQ ID NO: 4417 - DNA, 16 bp, Artificial sequence
  Synthetic oligonucleotide
aatgatgcccatgaga

SEQ ID NO: 4418 - DNA, 16 bp, Artificial sequence
  Synthetic oligonucleotide
tgcccattgaaggccc

SEQ ID NO: 4419 - DNA, 16 bp, Artificial sequence
  Synthetic oligonucleotide
ggcattcagatgccag

SEQ ID NO: 4420 - DNA, 16 bp, Artificial sequence
  Synthetic oligonucleotide
cagctcataagtgata

SEQ ID NO: 4421 - DNA, 16 bp, Artificial sequence
  Synthetic oligonucleotide
ttatcaacctggtttc

SEQ ID NO: 4422 - DNA, 16 bp, Artificial sequence
  Synthetic oligonucleotide
aaccctaagaggttta

SEQ ID NO: 4423 - DNA, 16 bp, Artificial sequence
  Synthetic oligonucleotide
tgcaccaggtgatggg

SEQ ID NO: 4424 - DNA, 16 bp, Artificial sequence
  Synthetic oligonucleotide
caggtacccttcatct

SEQ ID NO: 4425 - DNA, 16 bp, Artificial sequence
  Synthetic oligonucleotide
taatttagtgtctgga

SEQ ID NO: 4426 - DNA, 16 bp, Artificial sequence
  Synthetic oligonucleotide
catctggttcacaggc

SEQ ID NO: 4427 - DNA, 16 bp, Artificial sequence
  Synthetic oligonucleotide
accccaccaagtcagg

SEQ ID NO: 4428 - DNA, 16 bp, Artificial sequence
  Synthetic oligonucleotide
cagggttggaatgtgc

SEQ ID NO: 4429 - DNA, 16 bp, Artificial sequence
  Synthetic oligonucleotide
caccaagtttgggtaa

SEQ ID NO: 4430 - DNA, 16 bp, Artificial sequence
  Synthetic oligonucleotide
atgcagatgggatgga

SEQ ID NO: 4431 - DNA, 16 bp, Artificial sequence
  Synthetic oligonucleotide
ggacctttaagatgca

SEQ ID NO: 4432 - DNA, 16 bp, Artificial sequence
  Synthetic oligonucleotide
cagaactaggacagta

SEQ ID NO: 4433 - DNA, 16 bp, Artificial sequence
  Synthetic oligonucleotide
cttgccaaggaccaaa

SEQ ID NO: 4434 - DNA, 16 bp, Artificial sequence
  Synthetic oligonucleotide
ataagcttttgccact

SEQ ID NO: 4435 - DNA, 16 bp, Artificial sequence
  Synthetic oligonucleotide
atgctgagcagtgtct

SEQ ID NO: 4436 - DNA, 16 bp, Artificial sequence
  Synthetic oligonucleotide
cgaataatgagaattg

SEQ ID NO: 4437 - DNA, 16 bp, Artificial sequence
  Synthetic oligonucleotide
tactgtttgctagttc

SEQ ID NO: 4438 - DNA, 16 bp, Artificial sequence
  Synthetic oligonucleotide
atgctgttggttgatg

SEQ ID NO: 4439 - DNA, 16 bp, Artificial sequence
  Synthetic oligonucleotide
agcattgatgaatcag

SEQ ID NO: 4440 - DNA, 16 bp, Artificial sequence
  Synthetic oligonucleotide
tgtgctatagtgccat

SEQ ID NO: 4441 - DNA, 16 bp, Artificial sequence
  Synthetic oligonucleotide
agaaggctaccttagg

SEQ ID NO: 4442 - DNA, 16 bp, Artificial sequence
  Synthetic oligonucleotide
ggcttttggaaatggc

SEQ ID NO: 4443 - DNA, 16 bp, Artificial sequence
  Synthetic oligonucleotide
taaggttcaacaaggc

SEQ ID NO: 4444 - DNA, 16 bp, Artificial sequence
  Synthetic oligonucleotide
aaatttgcacattccc

SEQ ID NO: 4445 - DNA, 16 bp, Artificial sequence
  Synthetic oligonucleotide
ctcccaagtcaatact

SEQ ID NO: 4446 - DNA, 16 bp, Artificial sequence
  Synthetic oligonucleotide
gaatgtgcctacttgc

SEQ ID NO: 4447 - DNA, 16 bp, Artificial sequence
  Synthetic oligonucleotide
atagtacagttgatcc

SEQ ID NO: 4448 - DNA, 16 bp, Artificial sequence
  Synthetic oligonucleotide
actgttaaccactctg

SEQ ID NO: 4449 - DNA, 16 bp, Artificial sequence
  Synthetic oligonucleotide
ggtaagtcttcagtcc

SEQ ID NO: 4450 - DNA, 16 bp, Artificial sequence
  Synthetic oligonucleotide
gtcagatagctggagt

SEQ ID NO: 4451 - DNA, 16 bp, Artificial sequence
  Synthetic oligonucleotide
agaccctcaaaaaggt

SEQ ID NO: 4452 - DNA, 16 bp, Artificial sequence
  Synthetic oligonucleotide
gtactcaactgctcag

SEQ ID NO: 4453 - DNA, 16 bp, Artificial sequence
  Synthetic oligonucleotide
agggacaacacactct

SEQ ID NO: 4454 - DNA, 16 bp, Artificial sequence
  Synthetic oligonucleotide
ctccaactcctctgcg

SEQ ID NO: 4455 - DNA, 16 bp, Artificial sequence
  Synthetic oligonucleotide
caagcagagttccttg

SEQ ID NO: 4456 - DNA, 16 bp, Artificial sequence
  Synthetic oligonucleotide
gacaaggcttccctgc

SEQ ID NO: 4457 - DNA, 16 bp, Artificial sequence
  Synthetic oligonucleotide
ataccaggagagtaat

SEQ ID NO: 4458 - DNA, 16 bp, Artificial sequence
  Synthetic oligonucleotide
ttccaaagggtattgt

SEQ ID NO: 4459 - DNA, 16 bp, Artificial sequence
  Synthetic oligonucleotide
ccaagcttggtttacc

SEQ ID NO: 4460 - DNA, 16 bp, Artificial sequence
  Synthetic oligonucleotide
ctacttgccttgtgac

SEQ ID NO: 4461 - DNA, 16 bp, Artificial sequence
  Synthetic oligonucleotide
gagagatggacatggt

SEQ ID NO: 4462 - DNA, 16 bp, Artificial sequence
  Synthetic oligonucleotide
ctgtaggcccagggtt

SEQ ID NO: 4463 - DNA, 16 bp, Artificial sequence
  Synthetic oligonucleotide
ctaggaccatgccaag

SEQ ID NO: 4464 - DNA, 16 bp, Artificial sequence
  Synthetic oligonucleotide
cccgttcccaaccatc

SEQ ID NO: 4465 - DNA, 16 bp, Artificial sequence
  Synthetic oligonucleotide
agggaacgcagtgagc

SEQ ID NO: 4466 - DNA, 16 bp, Artificial sequence
  Synthetic oligonucleotide
ttccgcactctccctc

SEQ ID NO: 4467 - DNA, 16 bp, Artificial sequence
  Synthetic oligonucleotide
cgttgtccgggttcct

SEQ ID NO: 4468 - DNA, 16 bp, Artificial sequence
  Synthetic oligonucleotide
gcccgcggccggctgg

SEQ ID NO: 4469 - DNA, 16 bp, Artificial sequence
  Synthetic oligonucleotide
gggagacggaggagcc

SEQ ID NO: 4470 - DNA, 16 bp, Artificial sequence
  Synthetic oligonucleotide
aagccccctgctcccg

SEQ ID NO: 4471 - DNA, 16 bp, Artificial sequence
  Synthetic oligonucleotide
gcaacagagctaaccc

SEQ ID NO: 4472 - DNA, 16 bp, Artificial sequence
  Synthetic oligonucleotide
ttcttccgcctaaccc

SEQ ID NO: 4473 - DNA, 16 bp, Artificial sequence
  Synthetic oligonucleotide
ctgggattcacctaca

SEQ ID NO: 4474 - DNA, 16 bp, Artificial sequence
  Synthetic oligonucleotide
cagcagtgaatcccag

SEQ ID NO: 4475 - DNA, 16 bp, Artificial sequence
  Synthetic oligonucleotide
tagttggcctttgcag

SEQ ID NO: 4476 - DNA, 16 bp, Artificial sequence
  Synthetic oligonucleotide
accacccatccagagt

SEQ ID NO: 4477 - DNA, 16 bp, Artificial sequence
  Synthetic oligonucleotide
gaggaggtgccattaa

SEQ ID NO: 4478 - DNA, 16 bp, Artificial sequence
  Synthetic oligonucleotide
tggacaaagctgctcc

SEQ ID NO: 4479 - DNA, 16 bp, Artificial sequence
  Synthetic oligonucleotide
ccgcccctgcgaacac

SEQ ID NO: 4480 - DNA, 16 bp, Artificial sequence
  Synthetic oligonucleotide
cctgagatttgtgcct

SEQ ID NO: 4481 - DNA, 16 bp, Artificial sequence
  Synthetic oligonucleotide
tcatctgctttccgca

SEQ ID NO: 4482 - DNA, 16 bp, Artificial sequence
  Synthetic oligonucleotide
gacaatcctggttccc

SEQ ID NO: 4483 - DNA, 16 bp, Artificial sequence
  Synthetic oligonucleotide
ccacaggtcatgagca

SEQ ID NO: 4484 - DNA, 16 bp, Artificial sequence
  Synthetic oligonucleotide
cttccgggctggcctc

SEQ ID NO: 4485 - DNA, 16 bp, Artificial sequence
  Synthetic oligonucleotide
taaggcccatctcccc

SEQ ID NO: 4486 - DNA, 16 bp, Artificial sequence
  Synthetic oligonucleotide
ccaagacccaaaccct

SEQ ID NO: 4487 - DNA, 16 bp, Artificial sequence
  Synthetic oligonucleotide
taagtcatagcctgcc

SEQ ID NO: 4488 - DNA, 16 bp, Artificial sequence
  Synthetic oligonucleotide
cccaaggtggaatcta

SEQ ID NO: 4489 - DNA, 16 bp, Artificial sequence
  Synthetic oligonucleotide
caccatacacatcccc

SEQ ID NO: 4490 - DNA, 16 bp, Artificial sequence
  Synthetic oligonucleotide
ctagcaccaggtaggc

SEQ ID NO: 4491 - DNA, 16 bp, Artificial sequence
  Synthetic oligonucleotide
cgatcactctagtgcc

SEQ ID NO: 4492 - DNA, 16 bp, Artificial sequence
  Synthetic oligonucleotide
ggcacttagacacagc

SEQ ID NO: 4493 - DNA, 16 bp, Artificial sequence
  Synthetic oligonucleotide
gaatgatgcccatgag

SEQ ID NO: 4494 - DNA, 16 bp, Artificial sequence
  Synthetic oligonucleotide
ttgcccattgaaggcc

SEQ ID NO: 4495 - DNA, 16 bp, Artificial sequence
  Synthetic oligonucleotide
aggcattcagatgcca

SEQ ID NO: 4496 - DNA, 16 bp, Artificial sequence
  Synthetic oligonucleotide
cgcccagagtcaccca

SEQ ID NO: 4497 - DNA, 16 bp, Artificial sequence
  Synthetic oligonucleotide
gttatcaacctggttt

SEQ ID NO: 4498 - DNA, 16 bp, Artificial sequence
  Synthetic oligonucleotide
caaccctaagaggttt

SEQ ID NO: 4499 - DNA, 16 bp, Artificial sequence
  Synthetic oligonucleotide
atgcaccaggtgatgg

SEQ ID NO: 4500 - DNA, 16 bp, Artificial sequence
  Synthetic oligonucleotide
aatggcaggtaccctt

SEQ ID NO: 4501 - DNA, 16 bp, Artificial sequence
  Synthetic oligonucleotide
aggtaatttagtgtct

SEQ ID NO: 4502 - DNA, 16 bp, Artificial sequence
  Synthetic oligonucleotide
gtccatctggttcaca

SEQ ID NO: 4503 - DNA, 16 bp, Artificial sequence
  Synthetic oligonucleotide
aaccccaccaagtcag

SEQ ID NO: 4504 - DNA, 16 bp, Artificial sequence
  Synthetic oligonucleotide
agtccagggttggaat

SEQ ID NO: 4505 - DNA, 16 bp, Artificial sequence
  Synthetic oligonucleotide
ggcaccaagtttgggt

SEQ ID NO: 4506 - DNA, 16 bp, Artificial sequence
  Synthetic oligonucleotide
aagatgcagatgggat

SEQ ID NO: 4507 - DNA, 16 bp, Artificial sequence
  Synthetic oligonucleotide
atggacctttaagatg

SEQ ID NO: 4508 - DNA, 16 bp, Artificial sequence
  Synthetic oligonucleotide
ccagaactaggacagt

SEQ ID NO: 4509 - DNA, 16 bp, Artificial sequence
  Synthetic oligonucleotide
acttgccaaggaccaa

SEQ ID NO: 4510 - DNA, 16 bp, Artificial sequence
  Synthetic oligonucleotide
aataagcttttgccac

SEQ ID NO: 4511 - DNA, 16 bp, Artificial sequence
  Synthetic oligonucleotide
aatgctgagcagtgtc

SEQ ID NO: 4512 - DNA, 16 bp, Artificial sequence
  Synthetic oligonucleotide
gcgaataatgagaatt

SEQ ID NO: 4513 - DNA, 16 bp, Artificial sequence
  Synthetic oligonucleotide
atactgtttgctagtt

SEQ ID NO: 4514 - DNA, 16 bp, Artificial sequence
  Synthetic oligonucleotide
tatgctgttggttgat

SEQ ID NO: 4515 - DNA, 16 bp, Artificial sequence
  Synthetic oligonucleotide
ttagcattgatgaatc

SEQ ID NO: 4516 - DNA, 16 bp, Artificial sequence
  Synthetic oligonucleotide
attcaggtgtgtgcta

SEQ ID NO: 4517 - DNA, 16 bp, Artificial sequence
  Synthetic oligonucleotide
agcacaagaaggctac

SEQ ID NO: 4518 - DNA, 16 bp, Artificial sequence
  Synthetic oligonucleotide
gggatttggcttttgg

SEQ ID NO: 4519 - DNA, 16 bp, Artificial sequence
  Synthetic oligonucleotide
ttaaggttcaacaagg

SEQ ID NO: 4520 - DNA, 16 bp, Artificial sequence
  Synthetic oligonucleotide
agtgaaaaatttgcac

SEQ ID NO: 4521 - DNA, 16 bp, Artificial sequence
  Synthetic oligonucleotide
actcccaagtcaatac

SEQ ID NO: 4522 - DNA, 16 bp, Artificial sequence
  Synthetic oligonucleotide
agaatgtgcctacttg

SEQ ID NO: 4523 - DNA, 16 bp, Artificial sequence
  Synthetic oligonucleotide
taatagtacagttgat

SEQ ID NO: 4524 - DNA, 16 bp, Artificial sequence
  Synthetic oligonucleotide
cactgttaaccactct

SEQ ID NO: 4525 - DNA, 16 bp, Artificial sequence
  Synthetic oligonucleotide
tgggtaagtcttcagt

SEQ ID NO: 4526 - DNA, 16 bp, Artificial sequence
  Synthetic oligonucleotide
agtcagatagctggag

SEQ ID NO: 4527 - DNA, 16 bp, Artificial sequence
  Synthetic oligonucleotide
cagaccctcaaaaagg

SEQ ID NO: 4528 - DNA, 16 bp, Artificial sequence
  Synthetic oligonucleotide
ctgtactcaactgctc

SEQ ID NO: 4529 - DNA, 16 bp, Artificial sequence
  Synthetic oligonucleotide
cagggacaacacactc

SEQ ID NO: 4530 - DNA, 16 bp, Artificial sequence
  Synthetic oligonucleotide
ggtacatgtctcccag

SEQ ID NO: 4531 - DNA, 16 bp, Artificial sequence
  Synthetic oligonucleotide
ccaagcagagttcctt

SEQ ID NO: 4532 - DNA, 16 bp, Artificial sequence
  Synthetic oligonucleotide
acctgtagaaagagac

SEQ ID NO: 4533 - DNA, 16 bp, Artificial sequence
  Synthetic oligonucleotide
gataccaggagagtaa

SEQ ID NO: 4534 - DNA, 16 bp, Artificial sequence
  Synthetic oligonucleotide
cttccaaagggtattg

SEQ ID NO: 4535 - DNA, 16 bp, Artificial sequence
  Synthetic oligonucleotide
tccaagcttggtttac

SEQ ID NO: 4536 - DNA, 16 bp, Artificial sequence
  Synthetic oligonucleotide
cctacttgccttgtga

SEQ ID NO: 4537 - DNA, 16 bp, Artificial sequence
  Synthetic oligonucleotide
gtctgagagatggaca

SEQ ID NO: 4538 - DNA, 16 bp, Artificial sequence
  Synthetic oligonucleotide
tattctgtaggcccag

SEQ ID NO: 4539 - DNA, 16 bp, Artificial sequence
  Synthetic oligonucleotide
tctaggaccatgccaa

SEQ ID NO: 4540 - DNA, 16 bp, Artificial sequence
  Synthetic oligonucleotide
ggcccgttcccaacca

SEQ ID NO: 4541 - DNA, 16 bp, Artificial sequence
  Synthetic oligonucleotide
gagggaacgcagtgag

SEQ ID NO: 4542 - DNA, 16 bp, Artificial sequence
  Synthetic oligonucleotide
tttccgcactctccct

SEQ ID NO: 4543 - DNA, 16 bp, Artificial sequence
  Synthetic oligonucleotide
ccccccacttcctaac

SEQ ID NO: 4544 - DNA, 16 bp, Artificial sequence
  Synthetic oligonucleotide
agcccgcggccggctg

SEQ ID NO: 4545 - DNA, 16 bp, Artificial sequence
  Synthetic oligonucleotide
cgctgggagacggagg

SEQ ID NO: 4546 - DNA, 16 bp, Artificial sequence
  Synthetic oligonucleotide
tcagacctggccacaa

SEQ ID NO: 4547 - DNA, 16 bp, Artificial sequence
  Synthetic oligonucleotide
cctagcagttgtgcct

SEQ ID NO: 4548 - DNA, 16 bp, Artificial sequence
  Synthetic oligonucleotide
ggcacccggaacgata

SEQ ID NO: 4549 - DNA, 16 bp, Artificial sequence
  Synthetic oligonucleotide
cctgggattcacctac

SEQ ID NO: 4550 - DNA, 16 bp, Artificial sequence
  Synthetic oligonucleotide
tcccagcagtgaatcc

SEQ ID NO: 4551 - DNA, 16 bp, Artificial sequence
  Synthetic oligonucleotide
ctagttggcctttgca

SEQ ID NO: 4552 - DNA, 16 bp, Artificial sequence
  Synthetic oligonucleotide
caccacccatccagag

SEQ ID NO: 4553 - DNA, 16 bp, Artificial sequence
  Synthetic oligonucleotide
ctctcgcagcaagccc

SEQ ID NO: 4554 - DNA, 16 bp, Artificial sequence
  Synthetic oligonucleotide
atggacaaagctgctc

SEQ ID NO: 4555 - DNA, 16 bp, Artificial sequence
  Synthetic oligonucleotide
cctccgcccctgcgaa

SEQ ID NO: 4556 - DNA, 16 bp, Artificial sequence
  Synthetic oligonucleotide
acctgagatttgtgcc

SEQ ID NO: 4557 - DNA, 16 bp, Artificial sequence
  Synthetic oligonucleotide
ctcatctgctttccgc

SEQ ID NO: 4558 - DNA, 16 bp, Artificial sequence
  Synthetic oligonucleotide
tgggacaatcctggtt

SEQ ID NO: 4559 - DNA, 16 bp, Artificial sequence
  Synthetic oligonucleotide
cccacaggtcatgagc

SEQ ID NO: 4560 - DNA, 16 bp, Artificial sequence
  Synthetic oligonucleotide
gccttccgggctggcc

SEQ ID NO: 4561 - DNA, 16 bp, Artificial sequence
  Synthetic oligonucleotide
ttaaggcccatctccc

SEQ ID NO: 4562 - DNA, 16 bp, Artificial sequence
  Synthetic oligonucleotide
gatttcttcccaagac

SEQ ID NO: 4563 - DNA, 16 bp, Artificial sequence
  Synthetic oligonucleotide
tgactataagtcatag

SEQ ID NO: 4564 - DNA, 16 bp, Artificial sequence
  Synthetic oligonucleotide
tcccaaggtggaatct

SEQ ID NO: 4565 - DNA, 16 bp, Artificial sequence
  Synthetic oligonucleotide
tgcaccatacacatcc

SEQ ID NO: 4566 - DNA, 16 bp, Artificial sequence
  Synthetic oligonucleotide
cctagcaccaggtagg

SEQ ID NO: 4567 - DNA, 16 bp, Artificial sequence
  Synthetic oligonucleotide
acgatcactctagtgc

SEQ ID NO: 4568 - DNA, 16 bp, Artificial sequence
  Synthetic oligonucleotide
gctccgagccaggctc

SEQ ID NO: 4569 - DNA, 16 bp, Artificial sequence
  Synthetic oligonucleotide
tgaatgatgcccatga

SEQ ID NO: 4570 - DNA, 16 bp, Artificial sequence
  Synthetic oligonucleotide
tccttgcccattgaag

SEQ ID NO: 4571 - DNA, 16 bp, Artificial sequence
  Synthetic oligonucleotide
agaggcattcagatgc

SEQ ID NO: 4572 - DNA, 16 bp, Artificial sequence
  Synthetic oligonucleotide
tcgcccagagtcaccc

SEQ ID NO: 4573 - DNA, 16 bp, Artificial sequence
  Synthetic oligonucleotide
tgttatcaacctggtt

SEQ ID NO: 4574 - DNA, 16 bp, Artificial sequence
  Synthetic oligonucleotide
cccttctcaacaaccc

SEQ ID NO: 4575 - DNA, 16 bp, Artificial sequence
  Synthetic oligonucleotide
ccatgcaccaggtgat

SEQ ID NO: 4576 - DNA, 16 bp, Artificial sequence
  Synthetic oligonucleotide
aaatggcaggtaccct

SEQ ID NO: 4577 - DNA, 16 bp, Artificial sequence
  Synthetic oligonucleotide
atgtaggtaatttagt

SEQ ID NO: 4578 - DNA, 16 bp, Artificial sequence
  Synthetic oligonucleotide
aggtccatctggttca

SEQ ID NO: 4579 - DNA, 16 bp, Artificial sequence
  Synthetic oligonucleotide
caaccccaccaagtca

SEQ ID NO: 4580 - DNA, 16 bp, Artificial sequence
  Synthetic oligonucleotide
gagtccagggttggaa

SEQ ID NO: 4581 - DNA, 16 bp, Artificial sequence
  Synthetic oligonucleotide
tagggcaccaagtttg

SEQ ID NO: 4582 - DNA, 16 bp, Artificial sequence
  Synthetic oligonucleotide
gaagttgtgtgcctgt

SEQ ID NO: 4583 - DNA, 16 bp, Artificial sequence
  Synthetic oligonucleotide
agatggacctttaaga

SEQ ID NO: 4584 - DNA, 16 bp, Artificial sequence
  Synthetic oligonucleotide
accagaactaggacag

SEQ ID NO: 4585 - DNA, 16 bp, Artificial sequence
  Synthetic oligonucleotide
cacttgccaaggacca

SEQ ID NO: 4586 - DNA, 16 bp, Artificial sequence
  Synthetic oligonucleotide
caataagcttttgcca

SEQ ID NO: 4587 - DNA, 16 bp, Artificial sequence
  Synthetic oligonucleotide
ccatgaaatgctgagc

SEQ ID NO: 4588 - DNA, 16 bp, Artificial sequence
  Synthetic oligonucleotide
taaccatcgcgaataa

SEQ ID NO: 4589 - DNA, 16 bp, Artificial sequence
  Synthetic oligonucleotide
taatactgtttgctag

SEQ ID NO: 4590 - DNA, 16 bp, Artificial sequence
  Synthetic oligonucleotide
gattatatgctgttgg

SEQ ID NO: 4591 - DNA, 16 bp, Artificial sequence
  Synthetic oligonucleotide
cttagcattgatgaat

SEQ ID NO: 4592 - DNA, 16 bp, Artificial sequence
  Synthetic oligonucleotide
tgattcaggtgtgtgc

SEQ ID NO: 4593 - DNA, 16 bp, Artificial sequence
  Synthetic oligonucleotide
tagttcctaagcacaa

SEQ ID NO: 4594 - DNA, 16 bp, Artificial sequence
  Synthetic oligonucleotide
cgtttttcacactttg

SEQ ID NO: 4595 - DNA, 16 bp, Artificial sequence
  Synthetic oligonucleotide
agttaaggttcaacaa

SEQ ID NO: 4596 - DNA, 16 bp, Artificial sequence
  Synthetic oligonucleotide
gcagtgaaaaatttgc

SEQ ID NO: 4597 - DNA, 16 bp, Artificial sequence
  Synthetic oligonucleotide
aactcccaagtcaata

SEQ ID NO: 4598 - DNA, 16 bp, Artificial sequence
  Synthetic oligonucleotide
gagaatgtgcctactt

SEQ ID NO: 4599 - DNA, 16 bp, Artificial sequence
  Synthetic oligonucleotide
aacggcagtaataata

SEQ ID NO: 4600 - DNA, 16 bp, Artificial sequence
  Synthetic oligonucleotide
gaagtcactgttaacc

SEQ ID NO: 4601 - DNA, 16 bp, Artificial sequence
  Synthetic oligonucleotide
ccttgggtaagtcttc

SEQ ID NO: 4602 - DNA, 16 bp, Artificial sequence
  Synthetic oligonucleotide
ttcaggagtcagatag

SEQ ID NO: 4603 - DNA, 16 bp, Artificial sequence
  Synthetic oligonucleotide
ggacagaccctcaaaa

SEQ ID NO: 4604 - DNA, 16 bp, Artificial sequence
  Synthetic oligonucleotide
cctgtactcaactgct

SEQ ID NO: 4605 - DNA, 16 bp, Artificial sequence
  Synthetic oligonucleotide
gcagggacaacacact

SEQ ID NO: 4606 - DNA, 16 bp, Artificial sequence
  Synthetic oligonucleotide
agggtacatgtctccc

SEQ ID NO: 4607 - DNA, 16 bp, Artificial sequence
  Synthetic oligonucleotide
ctccaagcagagttcc

SEQ ID NO: 4608 - DNA, 16 bp, Artificial sequence
  Synthetic oligonucleotide
acacctgtagaaagag

SEQ ID NO: 4609 - DNA, 16 bp, Artificial sequence
  Synthetic oligonucleotide
tgataccaggagagta

SEQ ID NO: 4610 - DNA, 16 bp, Artificial sequence
  Synthetic oligonucleotide
acttccaaagggtatt

SEQ ID NO: 4611 - DNA, 16 bp, Artificial sequence
  Synthetic oligonucleotide
ttccaagcttggttta

SEQ ID NO: 4612 - DNA, 16 bp, Artificial sequence
  Synthetic oligonucleotide
acctacttgccttgtg

SEQ ID NO: 4613 - DNA, 16 bp, Artificial sequence
  Synthetic oligonucleotide
ggtctgagagatggac

SEQ ID NO: 4614 - DNA, 16 bp, Artificial sequence
  Synthetic oligonucleotide
cctattctgtaggccc

SEQ ID NO: 4615 - DNA, 16 bp, Artificial sequence
  Synthetic oligonucleotide
agagtctaggaccatg

SEQ ID NO: 4616 - DNA, 16 bp, Artificial sequence
  Synthetic oligonucleotide
accacccggcctcctg

SEQ ID NO: 4617 - DNA, 16 bp, Artificial sequence
  Synthetic oligonucleotide
ggagggaacgcagtga

SEQ ID NO: 4618 - DNA, 16 bp, Artificial sequence
  Synthetic oligonucleotide
ttgccttggtgtctga

SEQ ID NO: 4619 - DNA, 16 bp, Artificial sequence
  Synthetic oligonucleotide
cccccccacttcctaa

SEQ ID NO: 4620 - DNA, 16 bp, Artificial sequence
  Synthetic oligonucleotide
agagcccgcggccggc

SEQ ID NO: 4621 - DNA, 16 bp, Artificial sequence
  Synthetic oligonucleotide
aagctgcgctgggaga

SEQ ID NO: 4622 - DNA, 16 bp, Artificial sequence
  Synthetic oligonucleotide
cgctctcagacctggc

SEQ ID NO: 4623 - DNA, 16 bp, Artificial sequence
  Synthetic oligonucleotide
tacccctgcccctagc

SEQ ID NO: 4624 - DNA, 16 bp, Artificial sequence
  Synthetic oligonucleotide
ttctgtaggcacccgg

SEQ ID NO: 4625 - DNA, 16 bp, Artificial sequence
  Synthetic oligonucleotide
tctacctgggattcac

SEQ ID NO: 4626 - DNA, 16 bp, Artificial sequence
  Synthetic oligonucleotide
atcccagcagtgaatc

SEQ ID NO: 4627 - DNA, 16 bp, Artificial sequence
  Synthetic oligonucleotide
ctagcccggagcgcgg

SEQ ID NO: 4628 - DNA, 16 bp, Artificial sequence
  Synthetic oligonucleotide
gcggaaacagaaaccc

SEQ ID NO: 4629 - DNA, 16 bp, Artificial sequence
  Synthetic oligonucleotide
cttcctctctcgcagc

SEQ ID NO: 4630 - DNA, 16 bp, Artificial sequence
  Synthetic oligonucleotide
gatggacaaagctgct

SEQ ID NO: 4631 - DNA, 16 bp, Artificial sequence
  Synthetic oligonucleotide
attcctccgcccctgc

SEQ ID NO: 4632 - DNA, 16 bp, Artificial sequence
  Synthetic oligonucleotide
gacctgagatttgtgc

SEQ ID NO: 4633 - DNA, 16 bp, Artificial sequence
  Synthetic oligonucleotide
ctgggacaatcctggt

SEQ ID NO: 4634 - DNA, 16 bp, Artificial sequence
  Synthetic oligonucleotide
acccacaggtcatgag

SEQ ID NO: 4635 - DNA, 16 bp, Artificial sequence
  Synthetic oligonucleotide
ggccttccgggctggc

SEQ ID NO: 4636 - DNA, 16 bp, Artificial sequence
  Synthetic oligonucleotide
cttaaggcccatctcc

SEQ ID NO: 4637 - DNA, 16 bp, Artificial sequence
  Synthetic oligonucleotide
tgctagtctgcagctt

SEQ ID NO: 4638 - DNA, 16 bp, Artificial sequence
  Synthetic oligonucleotide
ctgactataagtcata

SEQ ID NO: 4639 - DNA, 16 bp, Artificial sequence
  Synthetic oligonucleotide
ccgactgtgtgctctt

SEQ ID NO: 4640 - DNA, 16 bp, Artificial sequence
  Synthetic oligonucleotide
ctgcaccatacacatc

SEQ ID NO: 4641 - DNA, 16 bp, Artificial sequence
  Synthetic oligonucleotide
acctagcaccaggtag

SEQ ID NO: 4642 - DNA, 16 bp, Artificial sequence
  Synthetic oligonucleotide
agctcacgatcactct

SEQ ID NO: 4643 - DNA, 16 bp, Artificial sequence
  Synthetic oligonucleotide
tgctccgagccaggct

SEQ ID NO: 4644 - DNA, 16 bp, Artificial sequence
  Synthetic oligonucleotide
atgaatgatgcccatg

SEQ ID NO: 4645 - DNA, 16 bp, Artificial sequence
  Synthetic oligonucleotide
gatccttccttgccca

SEQ ID NO: 4646 - DNA, 16 bp, Artificial sequence
  Synthetic oligonucleotide
cttcagaggcattcag

SEQ ID NO: 4647 - DNA, 16 bp, Artificial sequence
  Synthetic oligonucleotide
cctcgcccagagtcac

SEQ ID NO: 4648 - DNA, 16 bp, Artificial sequence
  Synthetic oligonucleotide
tactgttatcaacctg

SEQ ID NO: 4649 - DNA, 16 bp, Artificial sequence
  Synthetic oligonucleotide
acatgggtttcccttc

SEQ ID NO: 4650 - DNA, 16 bp, Artificial sequence
  Synthetic oligonucleotide
ttccatgcaccaggtg

SEQ ID NO: 4651 - DNA, 16 bp, Artificial sequence
  Synthetic oligonucleotide
gaaatggcaggtaccc

SEQ ID NO: 4652 - DNA, 16 bp, Artificial sequence
  Synthetic oligonucleotide
catgtaggtaatttag

SEQ ID NO: 4653 - DNA, 16 bp, Artificial sequence
  Synthetic oligonucleotide
taaggtccatctggtt

SEQ ID NO: 4654 - DNA, 16 bp, Artificial sequence
  Synthetic oligonucleotide
ctcaaccccaccaagt

SEQ ID NO: 4655 - DNA, 16 bp, Artificial sequence
  Synthetic oligonucleotide
aaacttttgggtgtgg

SEQ ID NO: 4656 - DNA, 16 bp, Artificial sequence
  Synthetic oligonucleotide
gatagggcaccaagtt

SEQ ID NO: 4657 - DNA, 16 bp, Artificial sequence
  Synthetic oligonucleotide
atgaagttgtgtgcct

SEQ ID NO: 4658 - DNA, 16 bp, Artificial sequence
  Synthetic oligonucleotide
gagatggacctttaag

SEQ ID NO: 4659 - DNA, 16 bp, Artificial sequence
  Synthetic oligonucleotide
caaaccagaactagga

SEQ ID NO: 4660 - DNA, 16 bp, Artificial sequence
  Synthetic oligonucleotide
aaagtgcacttgccaa

SEQ ID NO: 4661 - DNA, 16 bp, Artificial sequence
  Synthetic oligonucleotide
tcaataagcttttgcc

SEQ ID NO: 4662 - DNA, 16 bp, Artificial sequence
  Synthetic oligonucleotide
gccatgaaatgctgag

SEQ ID NO: 4663 - DNA, 16 bp, Artificial sequence
  Synthetic oligonucleotide
atagaacataaccatc

SEQ ID NO: 4664 - DNA, 16 bp, Artificial sequence
  Synthetic oligonucleotide
cctaatactgtttgct

SEQ ID NO: 4665 - DNA, 16 bp, Artificial sequence
  Synthetic oligonucleotide
agattatatgctgttg

SEQ ID NO: 4666 - DNA, 16 bp, Artificial sequence
  Synthetic oligonucleotide
gcttagcattgatgaa

SEQ ID NO: 4667 - DNA, 16 bp, Artificial sequence
  Synthetic oligonucleotide
cttgattcaggtgtgt

SEQ ID NO: 4668 - DNA, 16 bp, Artificial sequence
  Synthetic oligonucleotide
gtagttcctaagcaca

SEQ ID NO: 4669 - DNA, 16 bp, Artificial sequence
  Synthetic oligonucleotide
agtctacttagtgcaa

SEQ ID NO: 4670 - DNA, 16 bp, Artificial sequence
  Synthetic oligonucleotide
cagttaaggttcaaca

SEQ ID NO: 4671 - DNA, 16 bp, Artificial sequence
  Synthetic oligonucleotide
atttgtgggcatgcac

SEQ ID NO: 4672 - DNA, 16 bp, Artificial sequence
  Synthetic oligonucleotide
taactcccaagtcaat

SEQ ID NO: 4673 - DNA, 16 bp, Artificial sequence
  Synthetic oligonucleotide
tgagaatgtgcctact

SEQ ID NO: 4674 - DNA, 16 bp, Artificial sequence
  Synthetic oligonucleotide
aaacggcagtaataat

SEQ ID NO: 4675 - DNA, 16 bp, Artificial sequence
  Synthetic oligonucleotide
gttgaagtcactgtta

SEQ ID NO: 4676 - DNA, 16 bp, Artificial sequence
  Synthetic oligonucleotide
acaacctgctagctgt

SEQ ID NO: 4677 - DNA, 16 bp, Artificial sequence
  Synthetic oligonucleotide
gttcaggagtcagata

SEQ ID NO: 4678 - DNA, 16 bp, Artificial sequence
  Synthetic oligonucleotide
aaggacagaccctcaa

SEQ ID NO: 4679 - DNA, 16 bp, Artificial sequence
  Synthetic oligonucleotide
cccctgtactcaactg

SEQ ID NO: 4680 - DNA, 16 bp, Artificial sequence
  Synthetic oligonucleotide
tgcagggacaacacac

SEQ ID NO: 4681 - DNA, 16 bp, Artificial sequence
  Synthetic oligonucleotide
cagggtacatgtctcc

SEQ ID NO: 4682 - DNA, 16 bp, Artificial sequence
  Synthetic oligonucleotide
ctctccaagcagagtt

SEQ ID NO: 4683 - DNA, 16 bp, Artificial sequence
  Synthetic oligonucleotide
gcacacctgtagaaag

SEQ ID NO: 4684 - DNA, 16 bp, Artificial sequence
  Synthetic oligonucleotide
ggtgataccaggagag

SEQ ID NO: 4685 - DNA, 16 bp, Artificial sequence
  Synthetic oligonucleotide
gacttccaaagggtat

SEQ ID NO: 4686 - DNA, 16 bp, Artificial sequence
  Synthetic oligonucleotide
gtttccaagcttggtt

SEQ ID NO: 4687 - DNA, 16 bp, Artificial sequence
  Synthetic oligonucleotide
aacctacttgccttgt

SEQ ID NO: 4688 - DNA, 16 bp, Artificial sequence
  Synthetic oligonucleotide
cacctttctggcagtg

SEQ ID NO: 4689 - DNA, 16 bp, Artificial sequence
  Synthetic oligonucleotide
tatccagcaacctatt

SEQ ID NO: 4690 - DNA, 16 bp, Artificial sequence
  Synthetic oligonucleotide
tcaggagagtctagga

SEQ ID NO: 4691 - DNA, 16 bp, Artificial sequence
  Synthetic oligonucleotide
acaccacccggcctcc

SEQ ID NO: 4692 - DNA, 16 bp, Artificial sequence
  Synthetic oligonucleotide
gtgcggcaggcttggg

SEQ ID NO: 4693 - DNA, 16 bp, Artificial sequence
  Synthetic oligonucleotide
cccacgcggcgcaccg

SEQ ID NO: 4694 - DNA, 16 bp, Artificial sequence
  Synthetic oligonucleotide
gccctctcggctcctc

SEQ ID NO: 4695 - DNA, 16 bp, Artificial sequence
  Synthetic oligonucleotide
gagagcccgcggccgg

SEQ ID NO: 4696 - DNA, 16 bp, Artificial sequence
  Synthetic oligonucleotide
gtggaagctgcgctgg

SEQ ID NO: 4697 - DNA, 16 bp, Artificial sequence
  Synthetic oligonucleotide
gcgctctcagacctgg

SEQ ID NO: 4698 - DNA, 16 bp, Artificial sequence
  Synthetic oligonucleotide
caaaggtctcctcccc

SEQ ID NO: 4699 - DNA, 16 bp, Artificial sequence
  Synthetic oligonucleotide
ccattctgtaggcacc

SEQ ID NO: 4700 - DNA, 16 bp, Artificial sequence
  Synthetic oligonucleotide
gattctacctgggatt

SEQ ID NO: 4701 - DNA, 16 bp, Artificial sequence
  Synthetic oligonucleotide
gatcccagcagtgaat

SEQ ID NO: 4702 - DNA, 16 bp, Artificial sequence
  Synthetic oligonucleotide
cccacactagcccgga

SEQ ID NO: 4703 - DNA, 16 bp, Artificial sequence
  Synthetic oligonucleotide
agcggaaacagaaacc

SEQ ID NO: 4704 - DNA, 16 bp, Artificial sequence
  Synthetic oligonucleotide
cccttcctctctcgca

SEQ ID NO: 4705 - DNA, 16 bp, Artificial sequence
  Synthetic oligonucleotide
cgatggacaaagctgc

SEQ ID NO: 4706 - DNA, 16 bp, Artificial sequence
  Synthetic oligonucleotide
acctggcacgcatcgg

SEQ ID NO: 4707 - DNA, 16 bp, Artificial sequence
  Synthetic oligonucleotide
tggacctgagatttgt

SEQ ID NO: 4708 - DNA, 16 bp, Artificial sequence
  Synthetic oligonucleotide
ctctcatctgctttcc

SEQ ID NO: 4709 - DNA, 16 bp, Artificial sequence
  Synthetic oligonucleotide
tcctgggacaatcctg

SEQ ID NO: 4710 - DNA, 16 bp, Artificial sequence
  Synthetic oligonucleotide
gacccacaggtcatga

SEQ ID NO: 4711 - DNA, 16 bp, Artificial sequence
  Synthetic oligonucleotide
acccagtctggttgtc

SEQ ID NO: 4712 - DNA, 16 bp, Artificial sequence
  Synthetic oligonucleotide
tcttaaggcccatctc

SEQ ID NO: 4713 - DNA, 16 bp, Artificial sequence
  Synthetic oligonucleotide
ttgctagtctgcagct

SEQ ID NO: 4714 - DNA, 16 bp, Artificial sequence
  Synthetic oligonucleotide
actgactataagtcat

SEQ ID NO: 4715 - DNA, 16 bp, Artificial sequence
  Synthetic oligonucleotide
accgactgtgtgctct

SEQ ID NO: 4716 - DNA, 16 bp, Artificial sequence
  Synthetic oligonucleotide
acactgcaccatacac

SEQ ID NO: 4717 - DNA, 16 bp, Artificial sequence
  Synthetic oligonucleotide
aagacctagcaccagg

SEQ ID NO: 4718 - DNA, 16 bp, Artificial sequence
  Synthetic oligonucleotide
cagctcacgatcactc

SEQ ID NO: 4719 - DNA, 16 bp, Artificial sequence
  Synthetic oligonucleotide
acctgctccgagccag

SEQ ID NO: 4720 - DNA, 16 bp, Artificial sequence
  Synthetic oligonucleotide
catgaatgatgcccat

SEQ ID NO: 4721 - DNA, 16 bp, Artificial sequence
  Synthetic oligonucleotide
cttgatccttccttgc

SEQ ID NO: 4722 - DNA, 16 bp, Artificial sequence
  Synthetic oligonucleotide
gcttcagaggcattca

SEQ ID NO: 4723 - DNA, 16 bp, Artificial sequence
  Synthetic oligonucleotide
tcaaatccctcgccca

SEQ ID NO: 4724 - DNA, 16 bp, Artificial sequence
  Synthetic oligonucleotide
ttactgttatcaacct

SEQ ID NO: 4725 - DNA, 16 bp, Artificial sequence
  Synthetic oligonucleotide
tcacatgggtttccct

SEQ ID NO: 4726 - DNA, 16 bp, Artificial sequence
  Synthetic oligonucleotide
atttccatgcaccagg

SEQ ID NO: 4727 - DNA, 16 bp, Artificial sequence
  Synthetic oligonucleotide
ggaaatggcaggtacc

SEQ ID NO: 4728 - DNA, 16 bp, Artificial sequence
  Synthetic oligonucleotide
gcatgtaggtaattta

SEQ ID NO: 4729 - DNA, 16 bp, Artificial sequence
  Synthetic oligonucleotide
ccaccagggtaaggtc

SEQ ID NO: 4730 - DNA, 16 bp, Artificial sequence
  Synthetic oligonucleotide
actcaaccccaccaag

SEQ ID NO: 4731 - DNA, 16 bp, Artificial sequence
  Synthetic oligonucleotide
agaaacttttgggtgt

SEQ ID NO: 4732 - DNA, 16 bp, Artificial sequence
  Synthetic oligonucleotide
ggatagggcaccaagt

SEQ ID NO: 4733 - DNA, 16 bp, Artificial sequence
  Synthetic oligonucleotide
agcatgaagttgtgtg

SEQ ID NO: 4734 - DNA, 16 bp, Artificial sequence
  Synthetic oligonucleotide
tgagatggacctttaa

SEQ ID NO: 4735 - DNA, 16 bp, Artificial sequence
  Synthetic oligonucleotide
ccaaaccagaactagg

SEQ ID NO: 4736 - DNA, 16 bp, Artificial sequence
  Synthetic oligonucleotide
gcaaagtgcacttgcc

SEQ ID NO: 4737 - DNA, 16 bp, Artificial sequence
  Synthetic oligonucleotide
gctcaataagcttttg

SEQ ID NO: 4738 - DNA, 16 bp, Artificial sequence
  Synthetic oligonucleotide
tgccatgaaatgctga

SEQ ID NO: 4739 - DNA, 16 bp, Artificial sequence
  Synthetic oligonucleotide
gttcaatgttcactgt

SEQ ID NO: 4740 - DNA, 16 bp, Artificial sequence
  Synthetic oligonucleotide
acctaatactgtttgc

SEQ ID NO: 4741 - DNA, 16 bp, Artificial sequence
  Synthetic oligonucleotide
cagattatatgctgtt

SEQ ID NO: 4742 - DNA, 16 bp, Artificial sequence
  Synthetic oligonucleotide
agcttagcattgatga

SEQ ID NO: 4743 - DNA, 16 bp, Artificial sequence
  Synthetic oligonucleotide
cacttgattcaggtgt

SEQ ID NO: 4744 - DNA, 16 bp, Artificial sequence
  Synthetic oligonucleotide
tgtagttcctaagcac

SEQ ID NO: 4745 - DNA, 16 bp, Artificial sequence
  Synthetic oligonucleotide
ctcagtctacttagtg

SEQ ID NO: 4746 - DNA, 16 bp, Artificial sequence
  Synthetic oligonucleotide
cccagttaaggttcaa

SEQ ID NO: 4747 - DNA, 16 bp, Artificial sequence
  Synthetic oligonucleotide
catttgtgggcatgca

SEQ ID NO: 4748 - DNA, 16 bp, Artificial sequence
  Synthetic oligonucleotide
gtaactcccaagtcaa

SEQ ID NO: 4749 - DNA, 16 bp, Artificial sequence
  Synthetic oligonucleotide
gtaaaacggcagtaat

SEQ ID NO: 4750 - DNA, 16 bp, Artificial sequence
  Synthetic oligonucleotide
gttgaatgttgaagtc

SEQ ID NO: 4751 - DNA, 16 bp, Artificial sequence
  Synthetic oligonucleotide
cacaacctgctagctg

SEQ ID NO: 4752 - DNA, 16 bp, Artificial sequence
  Synthetic oligonucleotide
aaacttgggttcagga

SEQ ID NO: 4753 - DNA, 16 bp, Artificial sequence
  Synthetic oligonucleotide
aaaggacagaccctca

SEQ ID NO: 4754 - DNA, 16 bp, Artificial sequence
  Synthetic oligonucleotide
tcccctgtactcaact

SEQ ID NO: 4755 - DNA, 16 bp, Artificial sequence
  Synthetic oligonucleotide
actgcagggacaacac

SEQ ID NO: 4756 - DNA, 16 bp, Artificial sequence
  Synthetic oligonucleotide
aggcagggtacatgtc

SEQ ID NO: 4757 - DNA, 16 bp, Artificial sequence
  Synthetic oligonucleotide
tatcacagtcccctct

SEQ ID NO: 4758 - DNA, 16 bp, Artificial sequence
  Synthetic oligonucleotide
gtgtagcacctttcac

SEQ ID NO: 4759 - DNA, 16 bp, Artificial sequence
  Synthetic oligonucleotide
ctggtgataccaggag

SEQ ID NO: 4760 - DNA, 16 bp, Artificial sequence
  Synthetic oligonucleotide
aactctccctctggac

SEQ ID NO: 4761 - DNA, 16 bp, Artificial sequence
  Synthetic oligonucleotide
agtttccaagcttggt

SEQ ID NO: 4762 - DNA, 16 bp, Artificial sequence
  Synthetic oligonucleotide
ttcttgaacctacttg

SEQ ID NO: 4763 - DNA, 16 bp, Artificial sequence
  Synthetic oligonucleotide
tcacctttctggcagt

SEQ ID NO: 4764 - DNA, 16 bp, Artificial sequence
  Synthetic oligonucleotide
agtatccagcaaccta

SEQ ID NO: 4765 - DNA, 16 bp, Artificial sequence
  Synthetic oligonucleotide
ctcaggagagtctagg

SEQ ID NO: 4766 - DNA, 16 bp, Artificial sequence
  Synthetic oligonucleotide
ccccccagagagctct

SEQ ID NO: 4767 - DNA, 16 bp, Artificial sequence
  Synthetic oligonucleotide
ttggtgcggcaggctt

SEQ ID NO: 4768 - DNA, 16 bp, Artificial sequence
  Synthetic oligonucleotide
gccccacgcggcgcac

SEQ ID NO: 4769 - DNA, 16 bp, Artificial sequence
  Synthetic oligonucleotide
cgccctctcggctcct

SEQ ID NO: 4770 - DNA, 16 bp, Artificial sequence
  Synthetic oligonucleotide
ctgaggacggagagcc

SEQ ID NO: 4771 - DNA, 16 bp, Artificial sequence
  Synthetic oligonucleotide
ggagaaggtagggcac

SEQ ID NO: 4772 - DNA, 16 bp, Artificial sequence
  Synthetic oligonucleotide
cccacgcacccaggtc

SEQ ID NO: 4773 - DNA, 16 bp, Artificial sequence
  Synthetic oligonucleotide
tcaaaggtctcctccc

SEQ ID NO: 4774 - DNA, 16 bp, Artificial sequence
  Synthetic oligonucleotide
acccattctgtaggca

SEQ ID NO: 4775 - DNA, 16 bp, Artificial sequence
  Synthetic oligonucleotide
ggattctacctgggat

SEQ ID NO: 4776 - DNA, 16 bp, Artificial sequence
  Synthetic oligonucleotide
gtatccccaggagatt

SEQ ID NO: 4777 - DNA, 16 bp, Artificial sequence
  Synthetic oligonucleotide
ctcccacactagcccg

SEQ ID NO: 4778 - DNA, 16 bp, Artificial sequence
  Synthetic oligonucleotide
gagcggaaacagaaac

SEQ ID NO: 4779 - DNA, 16 bp, Artificial sequence
  Synthetic oligonucleotide
acccactcatgccctt

SEQ ID NO: 4780 - DNA, 16 bp, Artificial sequence
  Synthetic oligonucleotide
ttgccgcccggacgat

SEQ ID NO: 4781 - DNA, 16 bp, Artificial sequence
  Synthetic oligonucleotide
taagagctcacctggc

SEQ ID NO: 4782 - DNA, 16 bp, Artificial sequence
  Synthetic oligonucleotide
gcgctgtggacctgag

SEQ ID NO: 4783 - DNA, 16 bp, Artificial sequence
  Synthetic oligonucleotide
cctctcatctgctttc

SEQ ID NO: 4784 - DNA, 16 bp, Artificial sequence
  Synthetic oligonucleotide
atcctgggacaatcct

SEQ ID NO: 4785 - DNA, 16 bp, Artificial sequence
  Synthetic oligonucleotide
ctggacccacaggtca

SEQ ID NO: 4786 - DNA, 16 bp, Artificial sequence
  Synthetic oligonucleotide
cacccagtctggttgt

SEQ ID NO: 4787 - DNA, 16 bp, Artificial sequence
  Synthetic oligonucleotide
ttcttaaggcccatct

SEQ ID NO: 4788 - DNA, 16 bp, Artificial sequence
  Synthetic oligonucleotide
gttgctagtctgcagc

SEQ ID NO: 4789 - DNA, 16 bp, Artificial sequence
  Synthetic oligonucleotide
aactgactataagtca

SEQ ID NO: 4790 - DNA, 16 bp, Artificial sequence
  Synthetic oligonucleotide
taccgactgtgtgctc

SEQ ID NO: 4791 - DNA, 16 bp, Artificial sequence
  Synthetic oligonucleotide
acacactgcaccatac

SEQ ID NO: 4792 - DNA, 16 bp, Artificial sequence
  Synthetic oligonucleotide
ataagacctagcacca

SEQ ID NO: 4793 - DNA, 16 bp, Artificial sequence
  Synthetic oligonucleotide
acagctcacgatcact

SEQ ID NO: 4794 - DNA, 16 bp, Artificial sequence
  Synthetic oligonucleotide
agcacctgctccgagc

SEQ ID NO: 4795 - DNA, 16 bp, Artificial sequence
  Synthetic oligonucleotide
gcatgaatgatgccca

SEQ ID NO: 4796 - DNA, 16 bp, Artificial sequence
  Synthetic oligonucleotide
agctcttgatccttcc

SEQ ID NO: 4797 - DNA, 16 bp, Artificial sequence
  Synthetic oligonucleotide
ggcttcagaggcattc

SEQ ID NO: 4798 - DNA, 16 bp, Artificial sequence
  Synthetic oligonucleotide
ctcaaatccctcgccc

SEQ ID NO: 4799 - DNA, 16 bp, Artificial sequence
  Synthetic oligonucleotide
tttactgttatcaacc

SEQ ID NO: 4800 - DNA, 16 bp, Artificial sequence
  Synthetic oligonucleotide
ctcacatgggtttccc

SEQ ID NO: 4801 - DNA, 16 bp, Artificial sequence
  Synthetic oligonucleotide
tctaaaaggtagtttc

SEQ ID NO: 4802 - DNA, 16 bp, Artificial sequence
  Synthetic oligonucleotide
gggaaatggcaggtac

SEQ ID NO: 4803 - DNA, 16 bp, Artificial sequence
  Synthetic oligonucleotide
ggcatgtaggtaattt

SEQ ID NO: 4804 - DNA, 16 bp, Artificial sequence
  Synthetic oligonucleotide
cccaccagggtaaggt

SEQ ID NO: 4805 - DNA, 16 bp, Artificial sequence
  Synthetic oligonucleotide
agagactcaaccccac

SEQ ID NO: 4806 - DNA, 16 bp, Artificial sequence
  Synthetic oligonucleotide
gagaaacttttgggtg

SEQ ID NO: 4807 - DNA, 16 bp, Artificial sequence
  Synthetic oligonucleotide
ttaggcaaggataggg

SEQ ID NO: 4808 - DNA, 16 bp, Artificial sequence
  Synthetic oligonucleotide
gagcatgaagttgtgt

SEQ ID NO: 4809 - DNA, 16 bp, Artificial sequence
  Synthetic oligonucleotide
ctgagatggaccttta

SEQ ID NO: 4810 - DNA, 16 bp, Artificial sequence
  Synthetic oligonucleotide
accaaaccagaactag

SEQ ID NO: 4811 - DNA, 16 bp, Artificial sequence
  Synthetic oligonucleotide
aaggcaaagtgcactt

SEQ ID NO: 4812 - DNA, 16 bp, Artificial sequence
  Synthetic oligonucleotide
ctgctcaataagcttt

SEQ ID NO: 4813 - DNA, 16 bp, Artificial sequence
  Synthetic oligonucleotide
taatgccatgaaatgc

SEQ ID NO: 4814 - DNA, 16 bp, Artificial sequence
  Synthetic oligonucleotide
tagttcaatgttcact

SEQ ID NO: 4815 - DNA, 16 bp, Artificial sequence
  Synthetic oligonucleotide
aacctaatactgtttg

SEQ ID NO: 4816 - DNA, 16 bp, Artificial sequence
  Synthetic oligonucleotide
ccagattatatgctgt

SEQ ID NO: 4817 - DNA, 16 bp, Artificial sequence
  Synthetic oligonucleotide
tcagcttagcattgat

SEQ ID NO: 4818 - DNA, 16 bp, Artificial sequence
  Synthetic oligonucleotide
agacacttgattcagg

SEQ ID NO: 4819 - DNA, 16 bp, Artificial sequence
  Synthetic oligonucleotide
ctgtgtagttcctaag

SEQ ID NO: 4820 - DNA, 16 bp, Artificial sequence
  Synthetic oligonucleotide
gtccttctcagtctac

SEQ ID NO: 4821 - DNA, 16 bp, Artificial sequence
  Synthetic oligonucleotide
tcccagttaaggttca

SEQ ID NO: 4822 - DNA, 16 bp, Artificial sequence
  Synthetic oligonucleotide
gccatttgtgggcatg

SEQ ID NO: 4823 - DNA, 16 bp, Artificial sequence
  Synthetic oligonucleotide
tgtaactcccaagtca

SEQ ID NO: 4824 - DNA, 16 bp, Artificial sequence
  Synthetic oligonucleotide
attgagaatgtgccta

SEQ ID NO: 4825 - DNA, 16 bp, Artificial sequence
  Synthetic oligonucleotide
tgtaaaacggcagtaa

SEQ ID NO: 4826 - DNA, 16 bp, Artificial sequence
  Synthetic oligonucleotide
ttgccacaaagtaggc

SEQ ID NO: 4827 - DNA, 16 bp, Artificial sequence
  Synthetic oligonucleotide
ccacaacctgctagct

SEQ ID NO: 4828 - DNA, 16 bp, Artificial sequence
  Synthetic oligonucleotide
aaaacttgggttcagg

SEQ ID NO: 4829 - DNA, 16 bp, Artificial sequence
  Synthetic oligonucleotide
aaaaggacagaccctc

SEQ ID NO: 4830 - DNA, 16 bp, Artificial sequence
  Synthetic oligonucleotide
ttcccctgtactcaac

SEQ ID NO: 4831 - DNA, 16 bp, Artificial sequence
  Synthetic oligonucleotide
aactgcagggacaaca

SEQ ID NO: 4832 - DNA, 16 bp, Artificial sequence
  Synthetic oligonucleotide
caggcagggtacatgt

SEQ ID NO: 4833 - DNA, 16 bp, Artificial sequence
  Synthetic oligonucleotide
ctatcacagtcccctc

SEQ ID NO: 4834 - DNA, 16 bp, Artificial sequence
  Synthetic oligonucleotide
cgggaggagagagccc

SEQ ID NO: 4835 - DNA, 16 bp, Artificial sequence
  Synthetic oligonucleotide
gaatcccaggtgtgtg

SEQ ID NO: 4836 - DNA, 16 bp, Artificial sequence
  Synthetic oligonucleotide
tgggaccactccttcc

SEQ ID NO: 4837 - DNA, 16 bp, Artificial sequence
  Synthetic oligonucleotide
aagtttccaagcttgg

SEQ ID NO: 4838 - DNA, 16 bp, Artificial sequence
  Synthetic oligonucleotide
cttcttgaacctactt

SEQ ID NO: 4839 - DNA, 16 bp, Artificial sequence
  Synthetic oligonucleotide
cgcccaggtcctccac

SEQ ID NO: 4840 - DNA, 16 bp, Artificial sequence
  Synthetic oligonucleotide
agtctccgagtatcca

SEQ ID NO: 4841 - DNA, 16 bp, Artificial sequence
  Synthetic oligonucleotide
tctcaggagagtctag

SEQ ID NO: 4842 - DNA, 16 bp, Artificial sequence
  Synthetic oligonucleotide
cccccccagagagctc

SEQ ID NO: 4843 - DNA, 16 bp, Artificial sequence
  Synthetic oligonucleotide
gaccctcactcaccca

SEQ ID NO: 4844 - DNA, 16 bp, Artificial sequence
  Synthetic oligonucleotide
cagccccacgcggcgc

SEQ ID NO: 4845 - DNA, 16 bp, Artificial sequence
  Synthetic oligonucleotide
gcgccctctcggctcc

SEQ ID NO: 4846 - DNA, 16 bp, Artificial sequence
  Synthetic oligonucleotide
gctgaggacggagagc

SEQ ID NO: 4847 - DNA, 16 bp, Artificial sequence
  Synthetic oligonucleotide
ctccccgggagctccg

SEQ ID NO: 4848 - DNA, 16 bp, Artificial sequence
  Synthetic oligonucleotide
ccccacgcacccaggt

SEQ ID NO: 4849 - DNA, 16 bp, Artificial sequence
  Synthetic oligonucleotide
atcaaaggtctcctcc

SEQ ID NO: 4850 - DNA, 16 bp, Artificial sequence
  Synthetic oligonucleotide
gcgccacccattctgt

SEQ ID NO: 4851 - DNA, 16 bp, Artificial sequence
  Synthetic oligonucleotide
ctgggattctacctgg

SEQ ID NO: 4852 - DNA, 16 bp, Artificial sequence
  Synthetic oligonucleotide
gattctccctgtatcc

SEQ ID NO: 4853 - DNA, 16 bp, Artificial sequence
  Synthetic oligonucleotide
aacctggctcccacac

SEQ ID NO: 4854 - DNA, 16 bp, Artificial sequence
  Synthetic oligonucleotide
ggagcggaaacagaaa

SEQ ID NO: 4855 - DNA, 16 bp, Artificial sequence
  Synthetic oligonucleotide
aacccactcatgccct

SEQ ID NO: 4856 - DNA, 16 bp, Artificial sequence
  Synthetic oligonucleotide
acgcttgccgcccgga

SEQ ID NO: 4857 - DNA, 16 bp, Artificial sequence
  Synthetic oligonucleotide
ctaagagctcacctgg

SEQ ID NO: 4858 - DNA, 16 bp, Artificial sequence
  Synthetic oligonucleotide
aacacgcagctcagcg

SEQ ID NO: 4859 - DNA, 16 bp, Artificial sequence
  Synthetic oligonucleotide
ccctctcatctgcttt

SEQ ID NO: 4860 - DNA, 16 bp, Artificial sequence
  Synthetic oligonucleotide
aacaatcctgggacaa

SEQ ID NO: 4861 - DNA, 16 bp, Artificial sequence
  Synthetic oligonucleotide
agtcacctggacccac

SEQ ID NO: 4862 - DNA, 16 bp, Artificial sequence
  Synthetic oligonucleotide
ccacccagtctggttg

SEQ ID NO: 4863 - DNA, 16 bp, Artificial sequence
  Synthetic oligonucleotide
cttcttaaggcccatc

SEQ ID NO: 4864 - DNA, 16 bp, Artificial sequence
  Synthetic oligonucleotide
ctgttgctagtctgca

SEQ ID NO: 4865 - DNA, 16 bp, Artificial sequence
  Synthetic oligonucleotide
cagggaactgactata

SEQ ID NO: 4866 - DNA, 16 bp, Artificial sequence
  Synthetic oligonucleotide
gccacttaccgactgt

SEQ ID NO: 4867 - DNA, 16 bp, Artificial sequence
  Synthetic oligonucleotide
agactgcacacactgc

SEQ ID NO: 4868 - DNA, 16 bp, Artificial sequence
  Synthetic oligonucleotide
cataagacctagcacc

SEQ ID NO: 4869 - DNA, 16 bp, Artificial sequence
  Synthetic oligonucleotide
cacacagctcacgatc

SEQ ID NO: 4870 - DNA, 16 bp, Artificial sequence
  Synthetic oligonucleotide
catatctcaagcacct

SEQ ID NO: 4871 - DNA, 16 bp, Artificial sequence
  Synthetic oligonucleotide
ggcatgaatgatgccc

SEQ ID NO: 4872 - DNA, 16 bp, Artificial sequence
  Synthetic oligonucleotide
aagctcttgatccttc

SEQ ID NO: 4873 - DNA, 16 bp, Artificial sequence
  Synthetic oligonucleotide
gataaagctgggcttc

SEQ ID NO: 4874 - DNA, 16 bp, Artificial sequence
  Synthetic oligonucleotide
ggagaactcaaatccc

SEQ ID NO: 4875 - DNA, 16 bp, Artificial sequence
  Synthetic oligonucleotide
gtttactgttatcaac

SEQ ID NO: 4876 - DNA, 16 bp, Artificial sequence
  Synthetic oligonucleotide
tacctcacatgggttt

SEQ ID NO: 4877 - DNA, 16 bp, Artificial sequence
  Synthetic oligonucleotide
catctaaaaggtagtt

SEQ ID NO: 4878 - DNA, 16 bp, Artificial sequence
  Synthetic oligonucleotide
atggcagagcttgagg

SEQ ID NO: 4879 - DNA, 16 bp, Artificial sequence
  Synthetic oligonucleotide
tggcatgtaggtaatt

SEQ ID NO: 4880 - DNA, 16 bp, Artificial sequence
  Synthetic oligonucleotide
gcccaccagggtaagg

SEQ ID NO: 4881 - DNA, 16 bp, Artificial sequence
  Synthetic oligonucleotide
atgcttagagactcaa

SEQ ID NO: 4882 - DNA, 16 bp, Artificial sequence
  Synthetic oligonucleotide
ggagaaacttttgggt

SEQ ID NO: 4883 - DNA, 16 bp, Artificial sequence
  Synthetic oligonucleotide
attaggcaaggatagg

SEQ ID NO: 4884 - DNA, 16 bp, Artificial sequence
  Synthetic oligonucleotide
tgagcatgaagttgtg

SEQ ID NO: 4885 - DNA, 16 bp, Artificial sequence
  Synthetic oligonucleotide
gatctgagatggacct

SEQ ID NO: 4886 - DNA, 16 bp, Artificial sequence
  Synthetic oligonucleotide
gaccaaaccagaacta

SEQ ID NO: 4887 - DNA, 16 bp, Artificial sequence
  Synthetic oligonucleotide
caaggcaaagtgcact

SEQ ID NO: 4888 - DNA, 16 bp, Artificial sequence
  Synthetic oligonucleotide
acctgctcaataagct

SEQ ID NO: 4889 - DNA, 16 bp, Artificial sequence
  Synthetic oligonucleotide
catgagataatgccat

SEQ ID NO: 4890 - DNA, 16 bp, Artificial sequence
  Synthetic oligonucleotide
ctagttcaatgttcac

SEQ ID NO: 4891 - DNA, 16 bp, Artificial sequence
  Synthetic oligonucleotide
gaacctaatactgttt

SEQ ID NO: 4892 - DNA, 16 bp, Artificial sequence
  Synthetic oligonucleotide
accagattatatgctg

SEQ ID NO: 4893 - DNA, 16 bp, Artificial sequence
  Synthetic oligonucleotide
catcagcttagcattg

SEQ ID NO: 4894 - DNA, 16 bp, Artificial sequence
  Synthetic oligonucleotide
tagacacttgattcag

SEQ ID NO: 4895 - DNA, 16 bp, Artificial sequence
  Synthetic oligonucleotide
agctgtgtagttccta

SEQ ID NO: 4896 - DNA, 16 bp, Artificial sequence
  Synthetic oligonucleotide
aatgagtgtccttctc

SEQ ID NO: 4897 - DNA, 16 bp, Artificial sequence
  Synthetic oligonucleotide
ttcccagttaaggttc

SEQ ID NO: 4898 - DNA, 16 bp, Artificial sequence
  Synthetic oligonucleotide
ggccatttgtgggcat

SEQ ID NO: 4899 - DNA, 16 bp, Artificial sequence
  Synthetic oligonucleotide
ttgtaactcccaagtc

SEQ ID NO: 4900 - DNA, 16 bp, Artificial sequence
  Synthetic oligonucleotide
cattgagaatgtgcct

SEQ ID NO: 4901 - DNA, 16 bp, Artificial sequence
  Synthetic oligonucleotide
ctgtaaaacggcagta

SEQ ID NO: 4902 - DNA, 16 bp, Artificial sequence
  Synthetic oligonucleotide
acttgccacaaagtag

SEQ ID NO: 4903 - DNA, 16 bp, Artificial sequence
  Synthetic oligonucleotide
ctccacaacctgctag

SEQ ID NO: 4904 - DNA, 16 bp, Artificial sequence
  Synthetic oligonucleotide
aaaagttgggttcagg

SEQ ID NO: 4905 - DNA, 16 bp, Artificial sequence
  Synthetic oligonucleotide
ggaaaaggacagaccc

SEQ ID NO: 4906 - DNA, 16 bp, Artificial sequence
  Synthetic oligonucleotide
cttcccctgtactcaa

SEQ ID NO: 4907 - DNA, 16 bp, Artificial sequence
  Synthetic oligonucleotide
gaactgcagggacaac

SEQ ID NO: 4908 - DNA, 16 bp, Artificial sequence
  Synthetic oligonucleotide
acaggcagggtacatg

SEQ ID NO: 4909 - DNA, 16 bp, Artificial sequence
  Synthetic oligonucleotide
cctatcacagtcccct

SEQ ID NO: 4910 - DNA, 16 bp, Artificial sequence
  Synthetic oligonucleotide
atgaggcgggaggaga

SEQ ID NO: 4911 - DNA, 16 bp, Artificial sequence
  Synthetic oligonucleotide
agaatcccaggtgtgt

SEQ ID NO: 4912 - DNA, 16 bp, Artificial sequence
  Synthetic oligonucleotide
aaatgggaccactcct

SEQ ID NO: 4913 - DNA, 16 bp, Artificial sequence
  Synthetic oligonucleotide
caagtttccaagcttg

SEQ ID NO: 4914 - DNA, 16 bp, Artificial sequence
  Synthetic oligonucleotide
ccttcttgaacctact

SEQ ID NO: 4915 - DNA, 16 bp, Artificial sequence
  Synthetic oligonucleotide
ccgcccaggtcctcca

SEQ ID NO: 4916 - DNA, 16 bp, Artificial sequence
  Synthetic oligonucleotide
caagtctccgagtatc

SEQ ID NO: 4917 - DNA, 16 bp, Artificial sequence
  Synthetic oligonucleotide
gtctcaggagagtcta

SEQ ID NO: 4918 - DNA, 16 bp, Artificial sequence
  Synthetic oligonucleotide
gacccccccagagagc

SEQ ID NO: 4919 - DNA, 16 bp, Artificial sequence
  Synthetic oligonucleotide
ttgccccagaccctca

SEQ ID NO: 4920 - DNA, 16 bp, Artificial sequence
  Synthetic oligonucleotide
cgccgggagcccggag

SEQ ID NO: 4921 - DNA, 16 bp, Artificial sequence
  Synthetic oligonucleotide
ggccggaatctagctc

SEQ ID NO: 4922 - DNA, 16 bp, Artificial sequence
  Synthetic oligonucleotide
cgggtactcgccggtc

SEQ ID NO: 4923 - DNA, 16 bp, Artificial sequence
  Synthetic oligonucleotide
tcctccccgggagctc

SEQ ID NO: 4924 - DNA, 16 bp, Artificial sequence
  Synthetic oligonucleotide
cgcccccacgcaccca

SEQ ID NO: 4925 - DNA, 16 bp, Artificial sequence
  Synthetic oligonucleotide
tgatcaaaggtctcct

SEQ ID NO: 4926 - DNA, 16 bp, Artificial sequence
  Synthetic oligonucleotide
aacccatcaggtcagc

SEQ ID NO: 4927 - DNA, 16 bp, Artificial sequence
  Synthetic oligonucleotide
cctgggattctacctg

SEQ ID NO: 4928 - DNA, 16 bp, Artificial sequence
  Synthetic oligonucleotide
tcgattctccctgtat

SEQ ID NO: 4929 - DNA, 16 bp, Artificial sequence
  Synthetic oligonucleotide
gaacctggctcccaca

SEQ ID NO: 4930 - DNA, 16 bp, Artificial sequence
  Synthetic oligonucleotide
caggatttgaatgggc

SEQ ID NO: 4931 - DNA, 16 bp, Artificial sequence
  Synthetic oligonucleotide
aaacccactcatgccc

SEQ ID NO: 4932 - DNA, 16 bp, Artificial sequence
  Synthetic oligonucleotide
accccatctgacaacg

SEQ ID NO: 4933 - DNA, 16 bp, Artificial sequence
  Synthetic oligonucleotide
gctaagagctcacctg

SEQ ID NO: 4934 - DNA, 16 bp, Artificial sequence
  Synthetic oligonucleotide
atcaccctgggtcgga

SEQ ID NO: 4935 - DNA, 16 bp, Artificial sequence
  Synthetic oligonucleotide
ctgcctatccaggagt

SEQ ID NO: 4936 - DNA, 16 bp, Artificial sequence
  Synthetic oligonucleotide
agctgcctatccagga

SEQ ID NO: 4937 - DNA, 16 bp, Artificial sequence
  Synthetic oligonucleotide
ccgttggtccagctgc

SEQ ID NO: 4938 - DNA, 16 bp, Artificial sequence
  Synthetic oligonucleotide
tccgttggtccagctg

SEQ ID NO: 4939 - DNA, 16 bp, Artificial sequence
  Synthetic oligonucleotide
tggcatccgtccgttg

SEQ ID NO: 4940 - DNA, 16 bp, Artificial sequence
  Synthetic oligonucleotide
atggcatccgtccgtt

SEQ ID NO: 4941 - DNA, 16 bp, Artificial sequence
  Synthetic oligonucleotide
ctcatggcatccgtcc

SEQ ID NO: 4942 - DNA, 16 bp, Artificial sequence
  Synthetic oligonucleotide
cctcatggcatccgtc

SEQ ID NO: 4943 - DNA, 16 bp, Artificial sequence
  Synthetic oligonucleotide
ccctcatggcatccgt

SEQ ID NO: 4944 - DNA, 16 bp, Artificial sequence
  Synthetic oligonucleotide
gagccctcatggcatc

SEQ ID NO: 4945 - DNA, 16 bp, Artificial sequence
  Synthetic oligonucleotide
atccgtccgttggtcc

SEQ ID NO: 4946 - DNA, 16 bp, Artificial sequence
  Synthetic oligonucleotide
gcatccgtccgttggt

SEQ ID NO: 4947 - DNA, 16 bp, Artificial sequence
  Synthetic oligonucleotide
atgccttgcagggtga

SEQ ID NO: 4948 - DNA, 16 bp, Artificial sequence
  Synthetic oligonucleotide
tcaccaaggagggaaa

SEQ ID NO: 4949 - DNA, 16 bp, Artificial sequence
  Synthetic oligonucleotide
ccactctctcactgcg

SEQ ID NO: 4950 - DNA, 16 bp, Artificial sequence
  Synthetic oligonucleotide
tgctcttcagctttgt

SEQ ID NO: 4951 - DNA, 16 bp, Artificial sequence
  Synthetic oligonucleotide
gtgtgctcttcagctt

SEQ ID NO: 4952 - DNA, 16 bp, Artificial sequence
  Synthetic oligonucleotide
ggtacagctgccggtg

SEQ ID NO: 4953 - DNA, 16 bp, Artificial sequence
  Synthetic oligonucleotide
cccagctgatgatgcc

SEQ ID NO: 4954 - DNA, 16 bp, Artificial sequence
  Synthetic oligonucleotide
caccaaggagggaaag

SEQ ID NO: 4955 - DNA, 16 bp, Artificial sequence
  Synthetic oligonucleotide
tctctcactgcggaat

SEQ ID NO: 4956 - DNA, 16 bp, Artificial sequence
  Synthetic oligonucleotide
aatcaccaaggaggga

SEQ ID NO: 4957 - DNA, 16 bp, Artificial sequence
  Synthetic oligonucleotide
cactctctcactgcgg

SEQ ID NO: 4958 - DNA, 16 bp, Artificial sequence
  Synthetic oligonucleotide
gtgctcttcagctttg

SEQ ID NO: 4959 - DNA, 16 bp, Artificial sequence
  Synthetic oligonucleotide
gatgccttgcagggtg

SEQ ID NO: 4960 - DNA, 16 bp, Artificial sequence
  Synthetic oligonucleotide
cagctgatgatgcctt

SEQ ID NO: 4961 - DNA, 16 bp, Artificial sequence
  Synthetic oligonucleotide
agccactctctcactg

SEQ ID NO: 4962 - DNA, 16 bp, Artificial sequence
  Synthetic oligonucleotide
cttgcagggtgagccg

SEQ ID NO: 4963 - DNA, 16 bp, Artificial sequence
  Synthetic oligonucleotide
gatgatgccttgcagg

SEQ ID NO: 4964 - DNA, 16 bp, Artificial sequence
  Synthetic oligonucleotide
gcgccatcctggcgcg

SEQ ID NO: 4965 - DNA, 16 bp, Artificial sequence
  Synthetic oligonucleotide
gaatcaccaaggaggg

SEQ ID NO: 4966 - DNA, 16 bp, Artificial sequence
  Synthetic oligonucleotide
atcaccaaggagggaa

SEQ ID NO: 4967 - DNA, 16 bp, Artificial sequence
  Synthetic oligonucleotide
gccactctctcactgc

SEQ ID NO: 4968 - DNA, 16 bp, Artificial sequence
  Synthetic oligonucleotide
gtacagctgccggtgg

SEQ ID NO: 4969 - DNA, 16 bp, Artificial sequence
  Synthetic oligonucleotide
tgatgccttgcagggt

SEQ ID NO: 4970 - DNA, 16 bp, Artificial sequence
  Synthetic oligonucleotide
ccagctgatgatgcct

SEQ ID NO: 4971 - DNA, 16 bp, Artificial sequence
  Synthetic oligonucleotide
ctctcactgcggaatc

SEQ ID NO: 4972 - DNA, 16 bp, Artificial sequence
  Synthetic oligonucleotide
cagccactctctcact

SEQ ID NO: 4973 - DNA, 16 bp, Artificial sequence
  Synthetic oligonucleotide
gtggtacagctgccgg

SEQ ID NO: 4974 - DNA, 16 bp, Artificial sequence
  Synthetic oligonucleotide
ccttgcagggtgagcc

SEQ ID NO: 4975 - DNA, 16 bp, Artificial sequence
  Synthetic oligonucleotide
tgatgatgccttgcag

SEQ ID NO: 4976 - DNA, 16 bp, Artificial sequence
  Synthetic oligonucleotide
actctctcactgcgga

SEQ ID NO: 4977 - DNA, 16 bp, Artificial sequence
  Synthetic oligonucleotide
  misc_feature (5)..(5): bases at these positions are RNA
gtgcucttcagctttg

SEQ ID NO: 4978 - DNA, 16 bp, Artificial sequence
  Synthetic oligonucleotide
  misc_feature (5)..(5): bases at these positions are RNA
tgtgugctcttcagct

SEQ ID NO: 4979 - DNA, 16 bp, Artificial sequence
  Synthetic oligonucleotide
  misc_feature (5)..(5): bases at these positions are RNA
actgugtgctcttcag

SEQ ID NO: 4980 - DNA, 16 bp, Artificial sequence
  Synthetic oligonucleotide
  misc_feature (5)..(5): bases at these positions are RNA
cgacugtgtgctcttc

SEQ ID NO: 4981 - DNA, 16 bp, Artificial sequence
  Synthetic oligonucleotide
  misc_feature (5)..(5): bases at these positions are RNA
gtgguacagctgccgg

SEQ ID NO: 4982 - DNA, 16 bp, Artificial sequence
  Synthetic oligonucleotide
  misc_feature (5)..(5): bases at these positions are RNA
tttguggtacagctgc

SEQ ID NO: 4983 - DNA, 16 bp, Artificial sequence
  Synthetic oligonucleotide
  misc_feature (5)..(5): bases at these positions are RNA
cattugtggtacagct

SEQ ID NO: 4984 - DNA, 16 bp, Artificial sequence
  Synthetic oligonucleotide
  misc_feature (5)..(5): bases at these positions are RNA
acatutgtggtacagc

SEQ ID NO: 4985 - DNA, 16 bp, Artificial sequence
  Synthetic oligonucleotide
  misc_feature (5)..(5): bases at these positions are RNA
tacauttgtggtacag

SEQ ID NO: 4986 - DNA, 16 bp, Artificial sequence
  Synthetic oligonucleotide
  misc_feature (5)..(5): bases at these positions are RNA
tggguacatttgtggt

SEQ ID NO: 4987 - DNA, 16 bp, Artificial sequence
  Synthetic oligonucleotide
  misc_feature (5)..(5): bases at these positions are RNA
gcctugcagggtgagc

SEQ ID NO: 4988 - DNA, 16 bp, Artificial sequence
  Synthetic oligonucleotide
  misc_feature (5)..(5): bases at these positions are RNA
tgccutgcagggtgag

SEQ ID NO: 4989 - DNA, 16 bp, Artificial sequence
  Synthetic oligonucleotide
  misc_feature (5)..(5): bases at these positions are RNA
atgaugccttgcaggg

SEQ ID NO: 4990 - DNA, 16 bp, Artificial sequence
  Synthetic oligonucleotide
  misc_feature (5)..(5): bases at these positions are RNA
ctgaugatgccttgca

SEQ ID NO: 4991 - DNA, 16 bp, Artificial sequence
  Synthetic oligonucleotide
  misc_feature (5)..(5): bases at these positions are RNA
cagcugatgatgcctt

SEQ ID NO: 4992 - DNA, 16 bp, Artificial sequence
  Synthetic oligonucleotide
  misc_feature (5)..(5): bases at these positions are RNA
tcccugagcaatcagg

SEQ ID NO: 4993 - DNA, 16 bp, Artificial sequence
  Synthetic oligonucleotide
  misc_feature (5)..(5): bases at these positions are RNA
tgaguccctgagcaat

SEQ ID NO: 4994 - DNA, 16 bp, Artificial sequence
  Synthetic oligonucleotide
  misc_feature (5)..(5): bases at these positions are RNA
aagaugagtccctgag

SEQ ID NO: 4995 - DNA, 16 bp, Artificial sequence
  Synthetic oligonucleotide
  misc_feature (5)..(5): bases at these positions are RNA
ggaaucaccaaggagg

SEQ ID NO: 4996 - DNA, 16 bp, Artificial sequence
  Synthetic oligonucleotide
  misc_feature (5)..(5): bases at these positions are RNA
tcacugcggaatcacc

SEQ ID NO: 4997 - DNA, 16 bp, Artificial sequence
  Synthetic oligonucleotide
  misc_feature (5)..(5): bases at these positions are RNA
tctcucactgcggaat

SEQ ID NO: 4998 - DNA, 16 bp, Artificial sequence
  Synthetic oligonucleotide
  misc_feature (5)..(5): bases at these positions are RNA
actcuctcactgcgga

SEQ ID NO: 4999 - DNA, 16 bp, Artificial sequence
  Synthetic oligonucleotide
  misc_feature (5)..(5): bases at these positions are RNA
ccacuctctcactgcg

SEQ ID NO: 5000 - DNA, 16 bp, Artificial sequence
  Synthetic oligonucleotide
  misc_feature (5)..(5): bases at these positions are RNA
ttccugcgccatcctg

SEQ ID NO: 5001 - DNA, 16 bp, Artificial sequence
  Synthetic oligonucleotide
  misc_feature (5)..(5): bases at these positions are RNA
gagtucctgcgccatc

SEQ ID NO: 5002 - DNA, 16 bp, Artificial sequence
  Synthetic oligonucleotide
  misc_feature (5)..(5): bases at these positions are RNA
tgagutcctgcgccat

SEQ ID NO: 5003 - DNA, 16 bp, Artificial sequence
  Synthetic oligonucleotide
  misc_feature (5)..(5): bases at these positions are RNA
ttatugagttcctgcg

SEQ ID NO: 5004 - DNA, 16 bp, Artificial sequence
  Synthetic oligonucleotide
  misc_feature (5)..(5): bases at these positions are RNA
acttuattgagttcct

SEQ ID NO: 5005 - DNA, 16 bp, Artificial sequence
  Synthetic oligonucleotide
  misc_feature (5)..(5): bases at these positions are RNA
cactutattgagttcc

SEQ ID NO: 5006 - DNA, 16 bp, Artificial sequence
  Synthetic oligonucleotide
  misc_feature (5)..(5): bases at these positions are RNA
gcacuttattgagttc

SEQ ID NO: 5007 - DNA, 16 bp, Artificial sequence
  Synthetic oligonucleotide
  misc_feature (5)..(5): bases at these positions are RNA
agcautttcaaagcac

SEQ ID NO: 5008 - DNA, 16 bp, Artificial sequence
  Synthetic oligonucleotide
  misc_feature (6)..(6): bases at these positions are RNA
tgctcutcagctttgt

SEQ ID NO: 5009 - DNA, 16 bp, Artificial sequence
  Synthetic oligonucleotide
  misc_feature (6)..(6): bases at these positions are RNA
tgtgcucttcagcttt

SEQ ID NO: 5010 - DNA, 16 bp, Artificial sequence
  Synthetic oligonucleotide
  misc_feature (6)..(6): bases at these positions are RNA
ctgtgugctcttcagc

SEQ ID NO: 5011 - DNA, 16 bp, Artificial sequence
  Synthetic oligonucleotide
  misc_feature (6)..(6): bases at these positions are RNA
acgacugtgtgctctt

SEQ ID NO: 5012 - DNA, 16 bp, Artificial sequence
  Synthetic oligonucleotide
  misc_feature (6)..(6): bases at these positions are RNA
tgtgguacagctgccg

SEQ ID NO: 5013 - DNA, 16 bp, Artificial sequence
  Synthetic oligonucleotide
  misc_feature (6)..(6): bases at these positions are RNA
atttguggtacagctg

SEQ ID NO: 5014 - DNA, 16 bp, Artificial sequence
  Synthetic oligonucleotide
  misc_feature (6)..(6): bases at these positions are RNA
acattugtggtacagc

SEQ ID NO: 5015 - DNA, 16 bp, Artificial sequence
  Synthetic oligonucleotide
  misc_feature (6)..(6): bases at these positions are RNA
tacatutgtggtacag

SEQ ID NO: 5016 - DNA, 16 bp, Artificial sequence
  Synthetic oligonucleotide
  misc_feature (6)..(6): bases at these positions are RNA
gtacauttgtggtaca

SEQ ID NO: 5017 - DNA, 16 bp, Artificial sequence
  Synthetic oligonucleotide
  misc_feature (6)..(6): bases at these positions are RNA
gtggguacatttgtgg

SEQ ID NO: 5018 - DNA, 16 bp, Artificial sequence
  Synthetic oligonucleotide
  misc_feature (6)..(6): bases at these positions are RNA
atgccutgcagggtga

SEQ ID NO: 5019 - DNA, 16 bp, Artificial sequence
  Synthetic oligonucleotide
  misc_feature (6)..(6): bases at these positions are RNA
gatgaugccttgcagg

SEQ ID NO: 5020 - DNA, 16 bp, Artificial sequence
  Synthetic oligonucleotide
  misc_feature (6)..(6): bases at these positions are RNA
gctgaugatgccttgc

SEQ ID NO: 5021 - DNA, 16 bp, Artificial sequence
  Synthetic oligonucleotide
  misc_feature (6)..(6): bases at these positions are RNA
ccagcugatgatgcct

SEQ ID NO: 5022 - DNA, 16 bp, Artificial sequence
  Synthetic oligonucleotide
  misc_feature (6)..(6): bases at these positions are RNA
gtcccugagcaatcag

SEQ ID NO: 5023 - DNA, 16 bp, Artificial sequence
  Synthetic oligonucleotide
  misc_feature (6)..(6): bases at these positions are RNA
atgaguccctgagcaa

SEQ ID NO: 5024 - DNA, 16 bp, Artificial sequence
  Synthetic oligonucleotide
  misc_feature (6)..(6): bases at these positions are RNA
aaagaugagtccctga

SEQ ID NO: 5025 - DNA, 16 bp, Artificial sequence
  Synthetic oligonucleotide
  misc_feature (6)..(6): bases at these positions are RNA
cggaaucaccaaggag

SEQ ID NO: 5026 - DNA, 16 bp, Artificial sequence
  Synthetic oligonucleotide
  misc_feature (6)..(6): bases at these positions are RNA
ctcacugcggaatcac

SEQ ID NO: 5027 - DNA, 16 bp, Artificial sequence
  Synthetic oligonucleotide
  misc_feature (6)..(6): bases at these positions are RNA
ctctcucactgcggaa

SEQ ID NO: 5028 - DNA, 16 bp, Artificial sequence
  Synthetic oligonucleotide
  misc_feature (6)..(6): bases at these positions are RNA
cactcuctcactgcgg

SEQ ID NO: 5029 - DNA, 16 bp, Artificial sequence
  Synthetic oligonucleotide
  misc_feature (6)..(6): bases at these positions are RNA
gccacuctctcactgc

SEQ ID NO: 5030 - DNA, 16 bp, Artificial sequence
  Synthetic oligonucleotide
  misc_feature (6)..(6): bases at these positions are RNA
cgccaucctggcgcgg

SEQ ID NO: 5031 - DNA, 16 bp, Artificial sequence
  Synthetic oligonucleotide
  misc_feature (6)..(6): bases at these positions are RNA
gttccugcgccatcct

SEQ ID NO: 5032 - DNA, 16 bp, Artificial sequence
  Synthetic oligonucleotide
  misc_feature (6)..(6): bases at these positions are RNA
tgagtucctgcgccat

SEQ ID NO: 5033 - DNA, 16 bp, Artificial sequence
  Synthetic oligonucleotide
  misc_feature (6)..(6): bases at these positions are RNA
ttgagutcctgcgcca

SEQ ID NO: 5034 - DNA, 16 bp, Artificial sequence
  Synthetic oligonucleotide
  misc_feature (6)..(6): bases at these positions are RNA
ctttautgagttcctg

SEQ ID NO: 5035 - DNA, 16 bp, Artificial sequence
  Synthetic oligonucleotide
  misc_feature (6)..(6): bases at these positions are RNA
cacttuattgagttcc

SEQ ID NO: 5036 - DNA, 16 bp, Artificial sequence
  Synthetic oligonucleotide
  misc_feature (6)..(6): bases at these positions are RNA
gcactutattgagttc

SEQ ID NO: 5037 - DNA, 16 bp, Artificial sequence
  Synthetic oligonucleotide
  misc_feature (6)..(6): bases at these positions are RNA
agcacuttattgagtt

SEQ ID NO: 5038 - DNA, 16 bp, Artificial sequence
  Synthetic oligonucleotide
  misc_feature (6)..(6): bases at these positions are RNA
agcatuttcaaagcac

SEQ ID NO: 5039 - DNA, 20 bp, Artificial sequence
  Synthetic oligonucleotide
  misc_feature (1)..(5): bases at these positions are RNA
  misc_feature (7)..(7): bases at these positions are RNA
  misc_feature (10)..(12): bases at these positions are RNA
  misc_feature (15)..(20): bases at these positions are RNA
cacuutattgagttccugcg

SEQ ID NO: 5040 - DNA, 20 bp, Artificial sequence
  Synthetic oligonucleotide
  misc_feature (1)..(10): bases at these positions are RNA
  misc_feature (12)..(12): bases at these positions are RNA
  misc_feature (14)..(14): bases at these positions are RNA
  misc_feature (16)..(20): bases at these positions are RNA
ccccagccactctctcacug

SEQ ID NO: 5041 - DNA, 20 bp, Artificial sequence
  Synthetic oligonucleotide
  misc_feature (1)..(6): bases at these positions are RNA
  misc_feature (8)..(13): bases at these positions are RNA
  misc_feature (15)..(20): bases at these positions are RNA
ucucactgcggaatcaccaa

SEQ ID NO: 5042 - RNA, 20 nt, Artificial sequence
  Synthetic oligonucleotide
gaaucaccaaggagggaaag

The invention claimed is:
1. An oligomeric compound according to the following chemical structure:

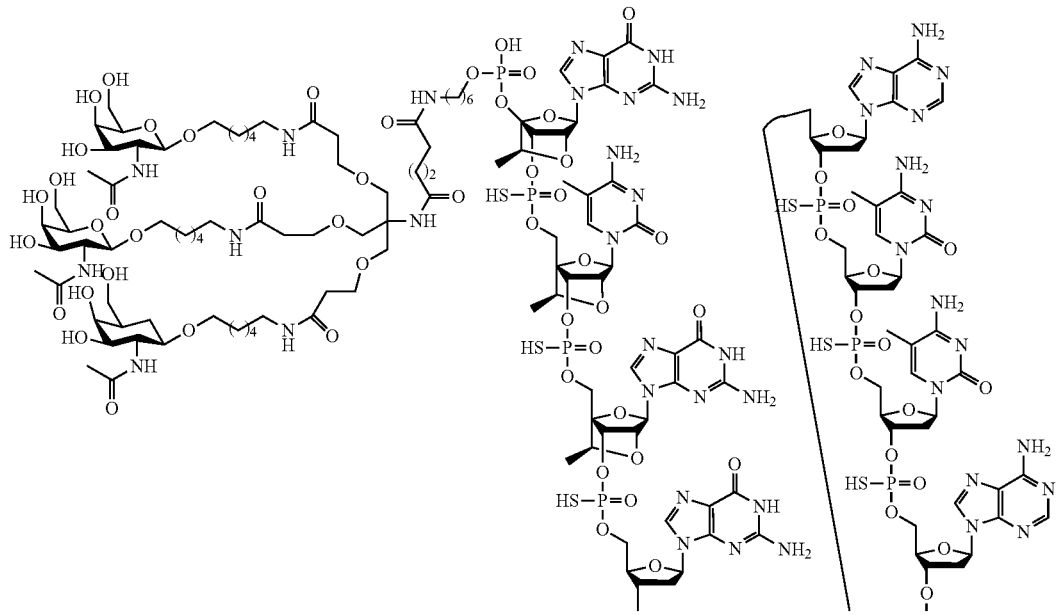

-continued
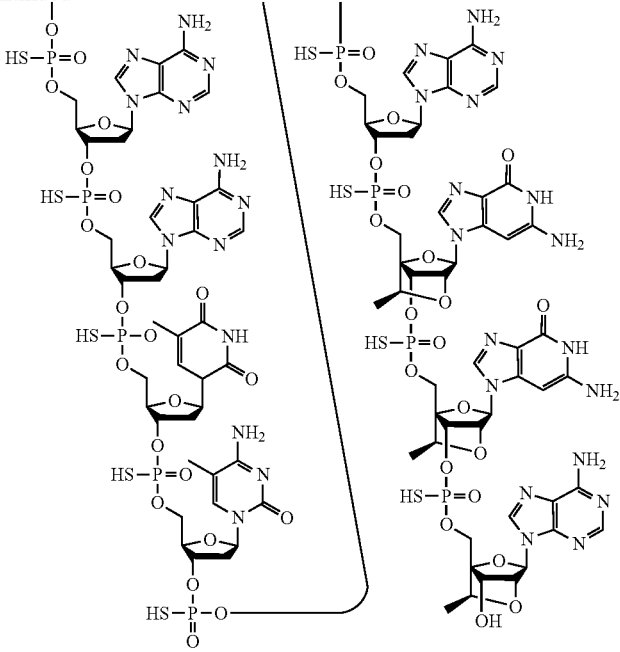
(SEQ ID NO: 3379), or a salt thereof.
2. The oligomeric compound of claim 1, which is the sodium salt or the potassium salt.

3. An oligomeric compound according to the following chemical structure:

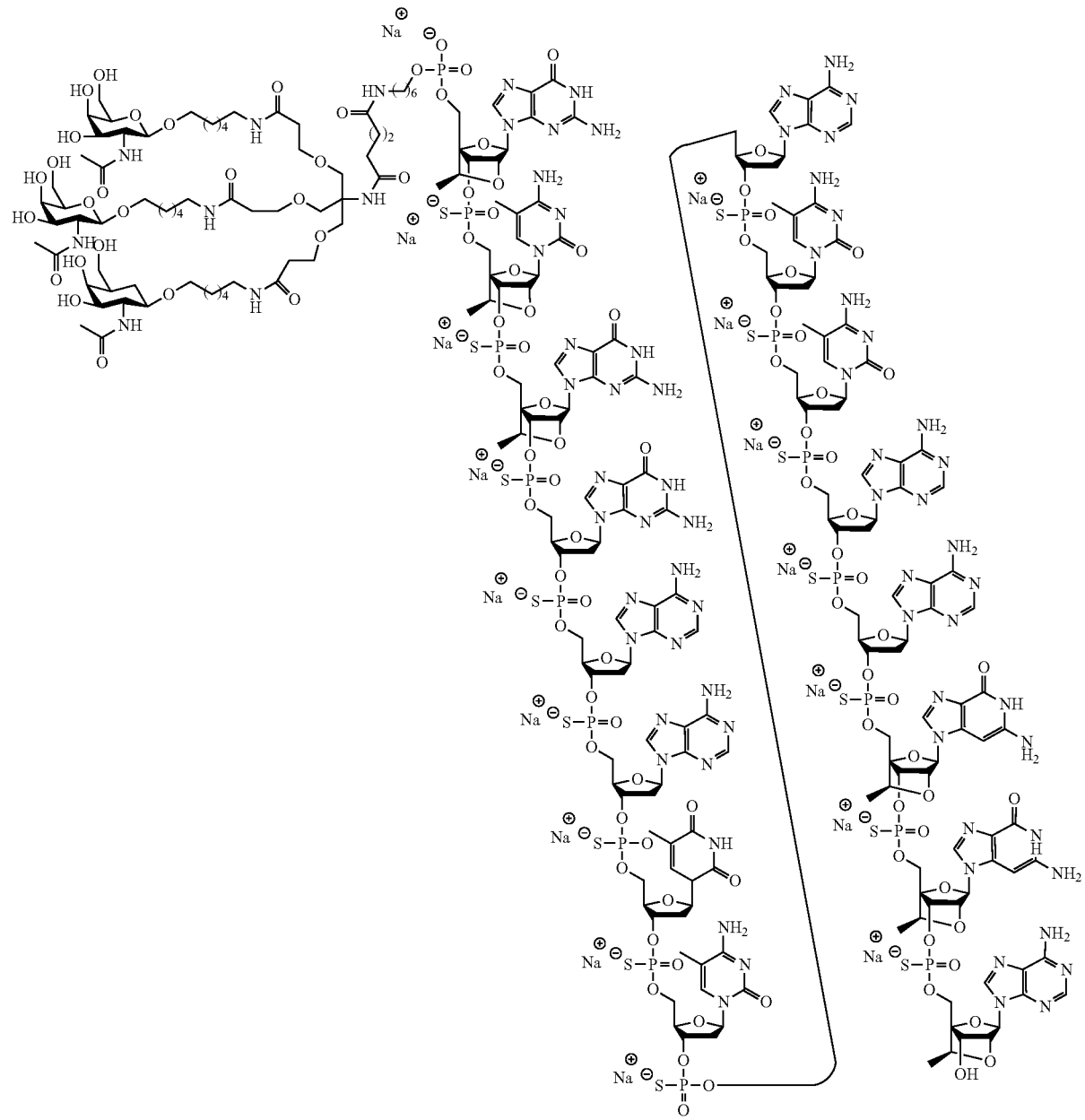

(SEQ ID NO: 3379).

4. An oligomeric compound comprising a modified oligonucleotide according to the following chemical notation: (THA-GalNAc₃)o Gks ᵐCks Gks Gds Ads Ads Tds ᵐCds Ads ᵐCds ᵐCds Ads Ads Gks Gks Ak (SEQ ID NO: 3379), wherein:

A=an adenine nucleobase,
mC=a 5-methyl cytosine nucleobase,
G=a guanine nucleobase,
T=a thymine nucleobase,
k=a cEt modified sugar moiety,
d=a 2'-β-D-deoxyribosyl sugar moiety,
o=a phosphodiester linkage, and
s=a phosphorothioate internucleoside linkage.

5. The oligomeric compound of claim 4, wherein THA-GalNAc₃ has the following chemical structure:

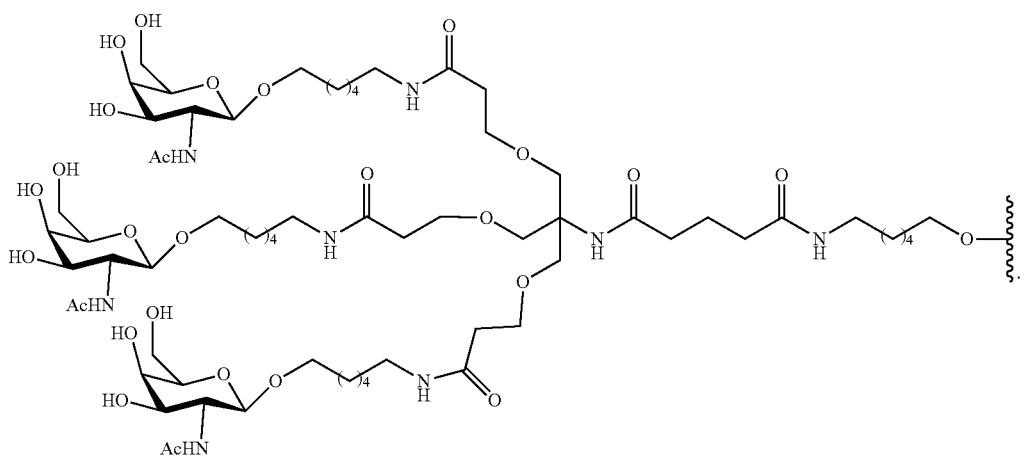

6. A population of oligomeric compounds of claim 1, wherein all of the phosphorothioate internucleoside linkages of the modified oligonucleotides are stereorandom.

7. A pharmaceutical composition comprising an oligomeric compound of claim 1 and a pharmaceutically acceptable diluent.

8. The pharmaceutical composition of claim 7, wherein the pharmaceutically acceptable diluent is phosphate-buffered saline (PBS) or water.

9. A population of oligomeric compounds of claim 2, wherein all of the phosphorothioate internucleoside linkages of the modified oligonucleotides are stereorandom.

10. A pharmaceutical composition comprising an oligomeric compound of claim 2 and a pharmaceutically acceptable diluent.

11. The pharmaceutical composition of claim 10, wherein the pharmaceutically acceptable diluent is phosphate-buffered saline (PBS) or water.

12. A population of oligomeric compounds of claim 3, wherein all of the phosphorothioate internucleoside linkages of the modified oligonucleotides are stereorandom.

13. A pharmaceutical composition comprising an oligomeric compound of claim 3 and a pharmaceutically acceptable diluent.

14. The pharmaceutical composition of claim 13, wherein the pharmaceutically acceptable diluent is phosphate-buffered saline (PBS) or water.

15. A population of oligomeric compounds of claim 4, wherein all of the phosphorothioate internucleoside linkages of the modified oligonucleotide are stereorandom.

16. A pharmaceutical composition comprising the oligomeric compound of claim 4 and a pharmaceutically acceptable diluent.

17. The pharmaceutical composition of claim 16, wherein the pharmaceutically acceptable diluent is phosphate-buffered saline (PBS) or water.

18. A method of reducing expression of FXII in a cell comprising contacting the cell with an oligomeric compound of claim 1.

19. The method of claim 18, wherein the contacting comprises administering the oligomeric compound of claim 1 to a subject.

20. The method of claim 19, wherein the subject is human.

21. A method of reducing expression of FXII in a cell comprising contacting the cell with an oligomeric compound of claim 2.

22. The method of claim 21, wherein the contacting comprises administering the oligomeric compound of claim 2 to a subject.

23. The method of claim 22, wherein the subject is human.

24. A method of reducing expression of FXII in a cell comprising contacting the cell with an oligomeric compound of claim 3.

25. The method of claim 24, wherein the contacting comprises administering the oligomeric compound of claim 3 to a subject.

26. The method of claim 25, wherein the subject is human.

27. A method of reducing expression of FXII in a cell comprising contacting the cell with an oligomeric compound of claim 4.

28. The method of claim 27, wherein the contacting comprises administering the oligomeric compound of claim 4 to a subject.

29. The method of claim 28, wherein the subject is human.

30. An oligomeric compound according to the following chemical structure:

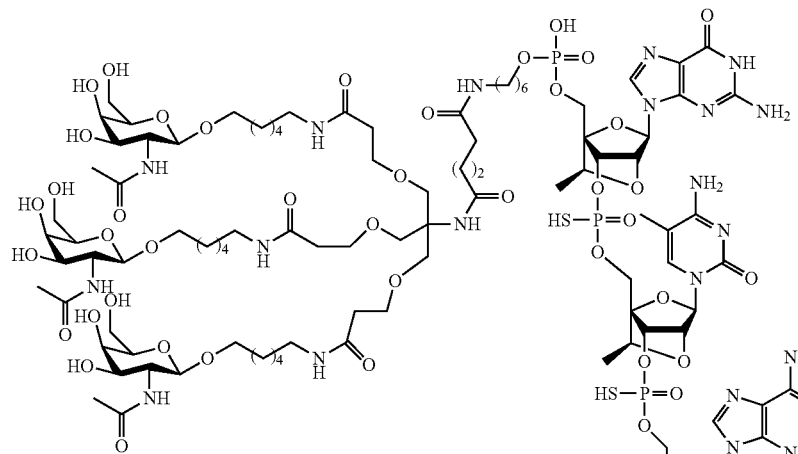
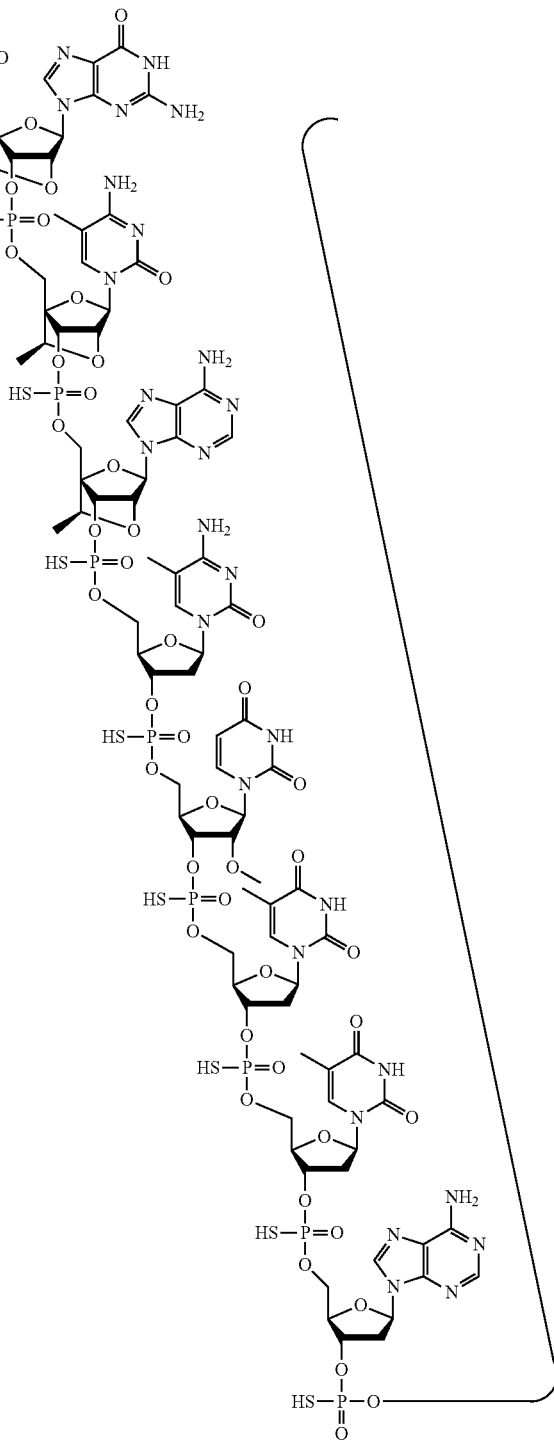

-continued
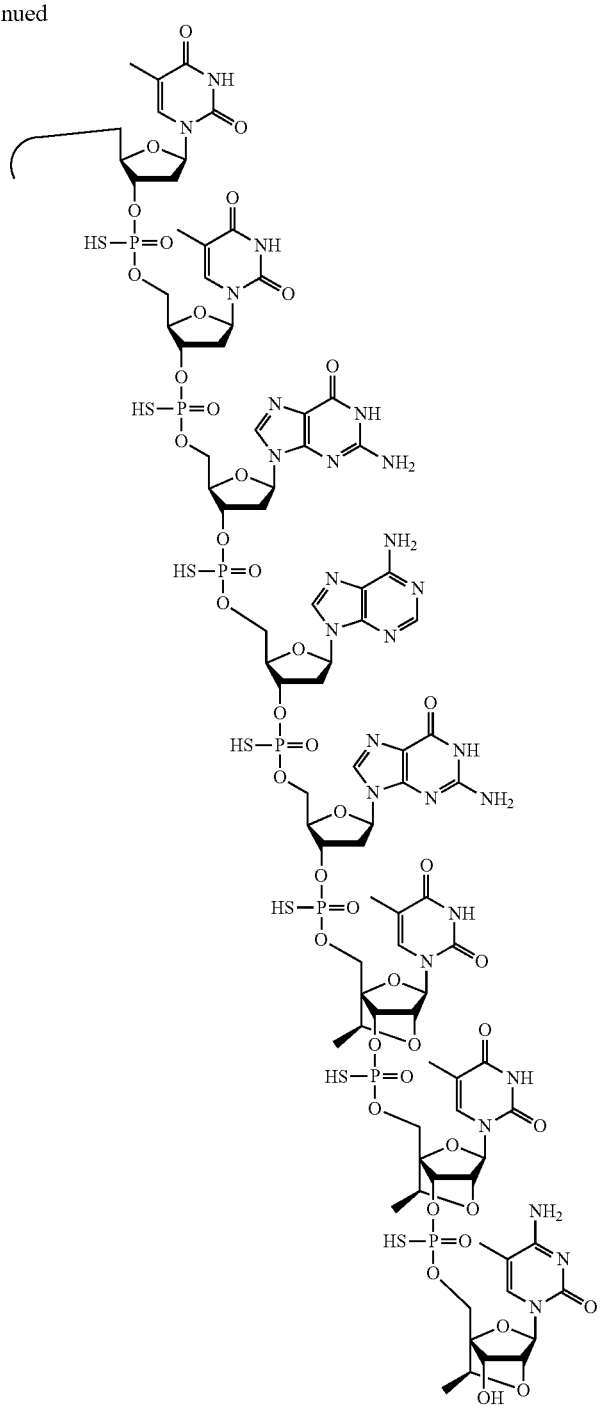
(SEQ ID NO: 5006), or a salt thereof.
31. The oligomeric compound of claim 30, which is the sodium salt or the potassium salt.

32. An oligomeric compound according to the following chemical structure:
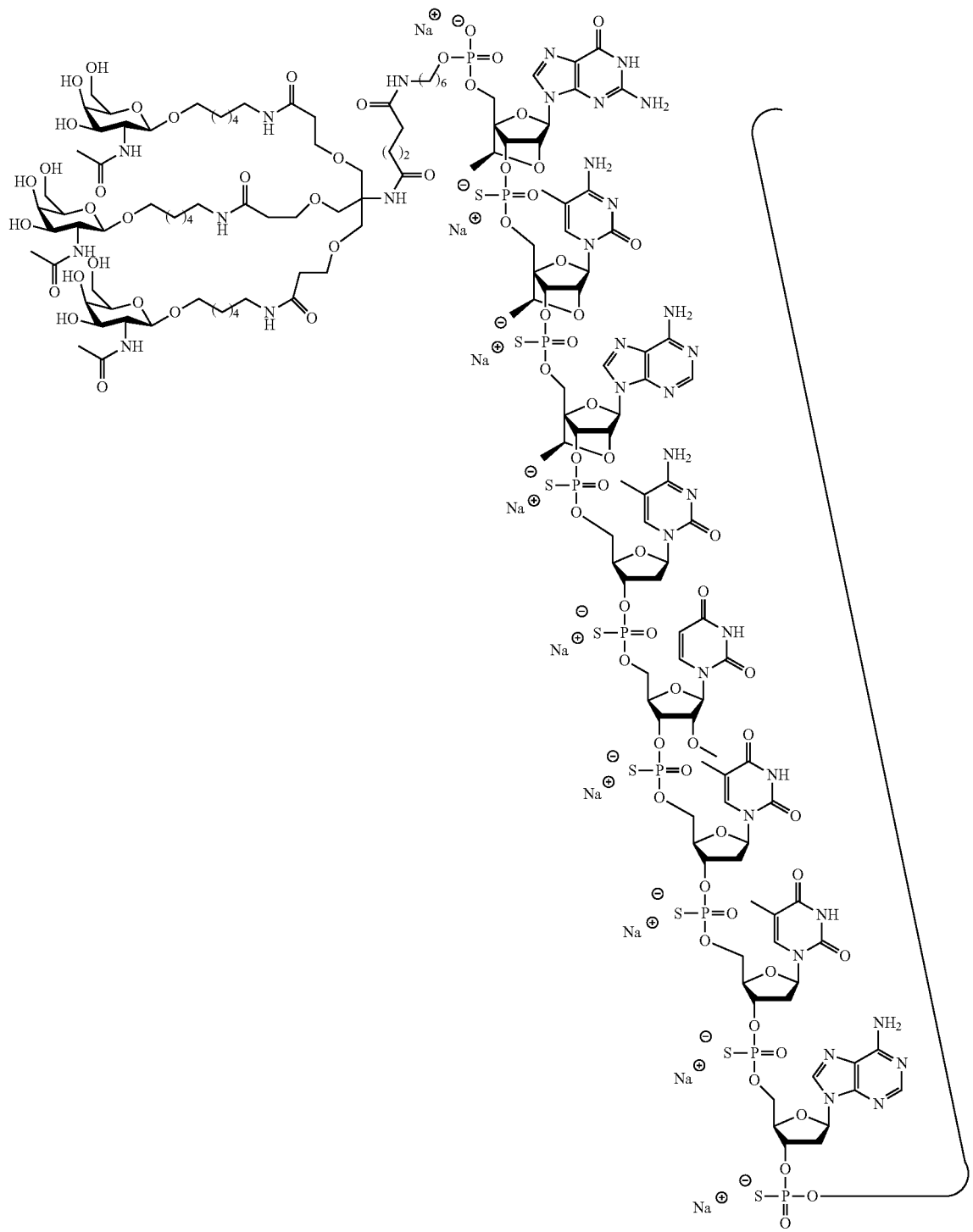

-continued

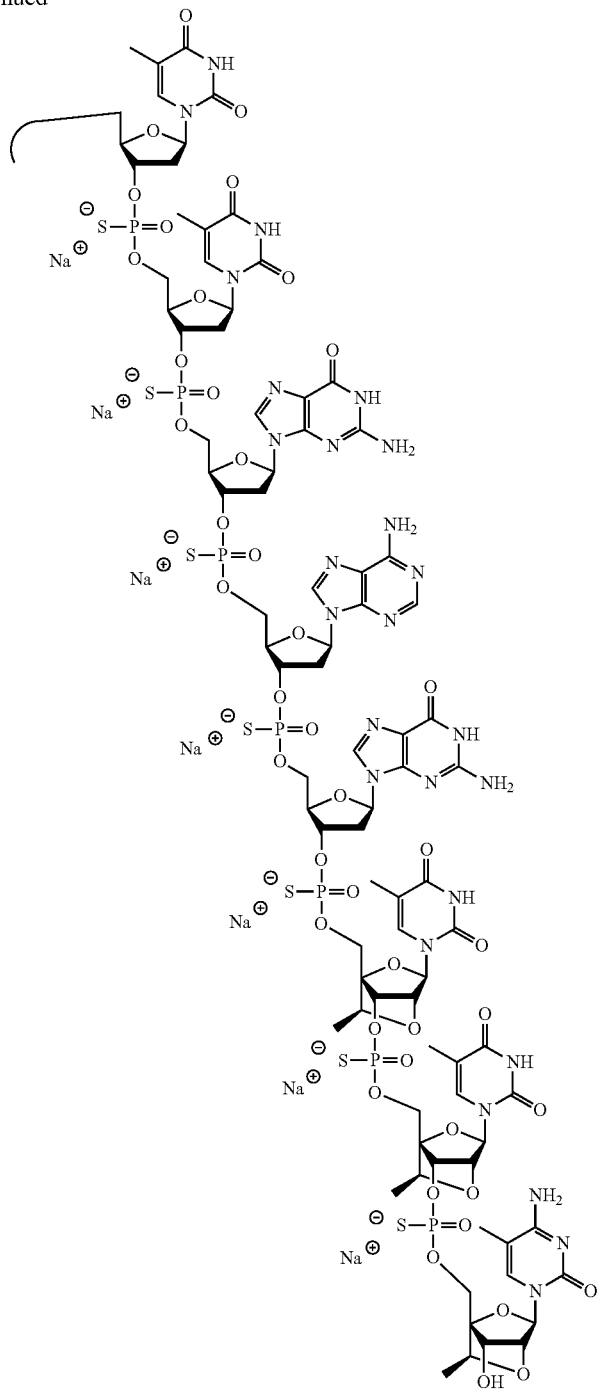

(SEQ ID NO: 5006).

33. An oligomeric compound comprising a modified oligonucleotide according to the following chemical notation: (THA-GalNAc₃)o Gks ᵐCks Aks ᵐCds Uys Tds Tds Ads Tds Tds Gds Ads Gds Tks Tks mCk (SEQ ID NO: 5006), wherein:
- A=an adenine nucleobase,
- mC=a 5-methyl cytosine nucleobase,
- G=a guanine nucleobase,
- T=a thymine nucleobase,
- U=a uracil nucleobase,
- k=a cEt modified sugar moiety,
- y=a 2'-O-methyl modified ribosyl sugar moiety,
- d=a 2'-β-D-deoxyribosyl sugar moiety,
- o=a phosphodiester linkage, and
- s=a phosphorothioate internucleoside linkage.

34. The oligomeric compound of claim 33, wherein THA-GalNAc₃ has the following chemical structure:

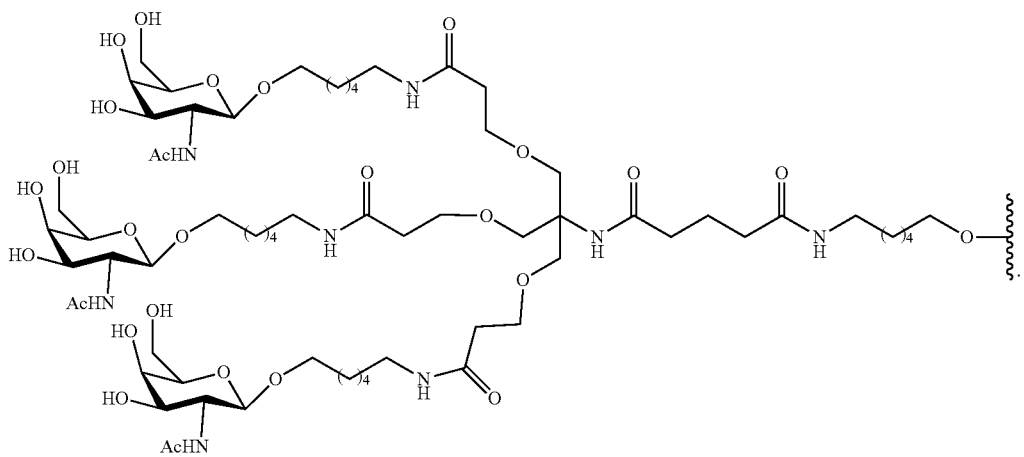

35. A population of oligomeric compounds of claim 30, wherein all of the phosphorothioate internucleoside linkages of the modified oligonucleotides are stereorandom.

36. A pharmaceutical composition comprising an oligomeric compound of claim 30 and a pharmaceutically acceptable diluent.

37. The pharmaceutical composition of claim 36, wherein the pharmaceutically acceptable diluent is phosphate-buffered saline (PBS) or water.

38. A population of oligomeric compounds of claim 31, wherein all of the phosphorothioate internucleoside linkages of the modified oligonucleotides are stereorandom.

39. A pharmaceutical composition comprising an oligomeric compound of claim 31 and a pharmaceutically acceptable diluent.

40. The pharmaceutical composition of claim 39, wherein the pharmaceutically acceptable diluent is phosphate-buffered saline (PBS) or water.

41. A population of oligomeric compounds of claim 32, wherein all of the phosphorothioate internucleoside linkages of the modified oligonucleotides are stereorandom.

42. A pharmaceutical composition comprising an oligomeric compound of claim 32 and a pharmaceutically acceptable diluent.

43. The pharmaceutical composition of claim 42, wherein the pharmaceutically acceptable diluent is phosphate-buffered saline (PBS) or water.

44. A population of oligomeric compounds of claim 33, wherein all of the phosphorothioate internucleoside linkages of the modified oligonucleotides are stereorandom.

45. A pharmaceutical composition comprising an oligomeric compound of claim 33 and a pharmaceutically acceptable diluent.

46. The pharmaceutical composition of claim 45, wherein the pharmaceutically acceptable diluent is phosphate-buffered saline (PBS) or water.

47. A method of reducing expression of FXII in a cell comprising contacting the cell with an oligomeric compound of claim 30.

48. The method of claim 47, wherein the contacting comprises administering the oligomeric compound of claim 30 to a subject.

49. The method of claim 48, wherein the subject is human.

50. A method of reducing expression of FXII in a cell comprising contacting the cell with an oligomeric compound of claim 31.

51. The method of claim 50, wherein the contacting comprises administering the oligomeric compound of claim 32 to a subject.

52. The method of claim 51, wherein the subject is human.

53. A method of reducing expression of FXII in a cell comprising contacting the cell with an oligomeric compound of claim 32.

54. The method of claim 53, wherein the contacting comprises administering the oligomeric compound of claim 32 to a subject.

55. The method of claim 54, wherein the subject is human.

56. A method of reducing expression of FXII in a cell comprising contacting the cell with an oligomeric compound of claim 33.

57. The method of claim 56, wherein the contacting comprises administering the oligomeric compound of claim 33 to a subject.

58. The method of claim 57, wherein the subject is human.

* * * * *